United States Patent
Jaffe et al.

(10) Patent No.: US 12,390,538 B2
(45) Date of Patent: Aug. 19, 2025

(54) COMPOSITIONS AND METHODS FOR EPIGENETIC REGULATION OF HBV GENE EXPRESSION

(71) Applicant: nChroma Bio, Inc., Boston, MA (US)

(72) Inventors: Aron Brandon Jaffe, Brookline, MA (US); Noorussahar Abubucker, Watertown, MA (US); Yesseinia Anglero-Rodriguez, Everett, MA (US); Vic Myer, Arlington, MA (US); Angelo Leone Lombardo, Rome (IT); Martino Alfredo Cappelluti, Milan (IT)

(73) Assignee: nChroma Bio, Inc., Boston, MA (US)

( * ) Notice: Subject to any disclaimer, the term of this patent is extended or adjusted under 35 U.S.C. 154(b) by 0 days.

(21) Appl. No.: 18/762,259

(22) Filed: Jul. 2, 2024

(65) Prior Publication Data
US 2024/0382621 A1  Nov. 21, 2024

Related U.S. Application Data

(63) Continuation of application No. PCT/US2024/029529, filed on May 15, 2024.

(60) Provisional application No. 63/581,236, filed on Sep. 7, 2023, provisional application No. 63/516,096, filed on Jul. 27, 2023, provisional application No. 63/502,325, filed on May 15, 2023.

(51) Int. Cl.
| A61K 48/00 | (2006.01) |
| A61P 31/20 | (2006.01) |
| C12N 9/10 | (2006.01) |
| C12N 9/22 | (2006.01) |
| C12N 15/11 | (2006.01) |

(52) U.S. Cl.
CPC .......... A61K 48/005 (2013.01); A61P 31/20 (2018.01); C12N 9/1007 (2013.01); C12N 9/22 (2013.01); C12N 15/11 (2013.01); C12Y 201/01037 (2013.01); *C07K 2319/00* (2013.01); *C07K 2319/80* (2013.01); *C12N 2310/20* (2017.05)

(58) Field of Classification Search
CPC ...... C12N 2310/20; C12N 9/22; C12N 15/11; C12N 15/1131; C12N 7/00; C07K 2319/80; C07K 14/4703; C07K 2319/00; C07K 2319/09; C12Y 201/01037
USPC ...................................................... 424/94.5
See application file for complete search history.

(56) References Cited

U.S. PATENT DOCUMENTS

| 5,795,778 A | 8/1998 | Draper |
| 6,017,756 A | 1/2000 | Draper |
| 6,453,242 B1 | 9/2002 | Eisenberg et al. |
| 6,534,261 B1 | 3/2003 | Cox, III et al. |
| 7,807,160 B2 | 10/2010 | Presta et al. |
| 7,901,708 B2 | 3/2011 | Maclachlan et al. |
| 8,058,069 B2 | 11/2011 | Yaworski et al. |
| 8,232,257 B2 | 7/2012 | McCaffrey et al. |
| 8,492,359 B2 | 7/2013 | Yaworski et al. |
| 8,642,076 B2 | 2/2014 | Manoharan et al. |
| 8,772,453 B2 | 7/2014 | Paschon et al. |
| 8,822,668 B2 | 9/2014 | Yaworski et al. |
| 8,889,418 B2 | 11/2014 | Zhang et al. |
| 8,906,616 B2 | 12/2014 | Zhang et al. |
| 9,005,654 B2 | 4/2015 | Maclachlan et al. |
| 9,006,417 B2 | 4/2015 | Yaworski et al. |
| 9,023,594 B2 | 5/2015 | Liu et al. |
| 9,023,649 B2 | 5/2015 | Mali et al. |
| 9,260,723 B2 | 2/2016 | Mali et al. |
| 9,301,923 B2 | 4/2016 | Baryza et al. |
| 9,364,435 B2 | 6/2016 | Yaworski et al. |
| 9,404,127 B2 | 8/2016 | Yaworski et al. |
| 9,415,109 B2 | 8/2016 | Kumar et al. |
| 9,487,802 B2 | 11/2016 | Quake et al. |
| 9,518,272 B2 | 12/2016 | Yaworski et al. |
| 9,580,701 B2 | 2/2017 | May et al. |
| 9,593,077 B2 | 3/2017 | Payne et al. |
| 9,650,617 B2 | 5/2017 | May et al. |
| 9,682,139 B2 | 6/2017 | Manoharan et al. |
| 9,688,972 B2 | 6/2017 | May et al. |
| 9,701,623 B2 | 7/2017 | Manoharan et al. |
| 9,771,590 B2 | 9/2017 | Brass et al. |
| 9,771,601 B2 | 9/2017 | May et al. |
| 9,840,702 B2 | 12/2017 | Collingwood et al. |
| 9,868,962 B2 | 1/2018 | May et al. |
| 9,878,042 B2 | 1/2018 | Yaworski et al. |
| 9,885,033 B2 | 2/2018 | Joung et al. |
| 9,932,566 B2 | 4/2018 | Kennedy et al. |
| 9,970,024 B2 | 5/2018 | Church et al. |
| 9,999,673 B2 | 6/2018 | Rajeev et al. |
| 10,059,940 B2 | 8/2018 | Zhong |

(Continued)

FOREIGN PATENT DOCUMENTS

| EP | 0642589 A1 | 3/1995 |
| EP | 1288296 A2 | 3/2003 |

(Continued)

OTHER PUBLICATIONS

Davos et al., (Proteins: Structure, Function and Genetics, 2000, vol. 41: 98-107.*

(Continued)

*Primary Examiner* — Robert B Mondesi
*Assistant Examiner* — Mohammad Y Meah
(74) *Attorney, Agent, or Firm* — WILSON SONSINI GOODRICH & ROSATI

(57) ABSTRACT

This invention relates to compositions, methods, strategies, and treatment modalities related to the epigenetic modification of hepatitis B virus (HBV) genes.

19 Claims, 57 Drawing Sheets

Specification includes a Sequence Listing.

(56) References Cited

U.S. PATENT DOCUMENTS

| | | |
|---|---|---|
| 10,137,201 B2 | 11/2018 | Brown et al. |
| 10,266,850 B2 | 4/2019 | Doudna et al. |
| 10,273,501 B2 | 4/2019 | Church et al. |
| 10,286,084 B2 | 5/2019 | Cullen et al. |
| 10,337,001 B2 | 7/2019 | Ryan et al. |
| 10,342,761 B2 | 7/2019 | Bowman et al. |
| 10,369,226 B2 | 8/2019 | Maier et al. |
| 10,378,015 B2 | 8/2019 | Brass et al. |
| 10,435,708 B2 | 10/2019 | Mali et al. |
| 10,519,468 B2 | 12/2019 | May et al. |
| 10,526,590 B2 | 1/2020 | Kennedy et al. |
| 10,544,405 B2 | 1/2020 | Weiss et al. |
| 10,612,044 B2 | 4/2020 | Hatada et al. |
| 10,662,416 B2 | 5/2020 | Jantz et al. |
| 10,696,986 B2 | 6/2020 | Zhang et al. |
| 10,717,990 B2 | 7/2020 | Mali et al. |
| 10,767,175 B2 | 9/2020 | Dellinger et al. |
| 10,767,176 B2 | 9/2020 | Collingwood et al. |
| 10,822,606 B2 | 11/2020 | Huang et al. |
| 10,844,403 B2 | 11/2020 | Joung et al. |
| 10,851,358 B2 | 12/2020 | Jantz et al. |
| 10,900,034 B2 | 1/2021 | Ryan et al. |
| 10,907,150 B2 | 2/2021 | Carlson-Stevermer et al. |
| 10,946,108 B2 | 3/2021 | Zhang et al. |
| 10,954,514 B2 | 3/2021 | Dahlman et al. |
| 10,988,781 B2 | 4/2021 | May et al. |
| 11,001,829 B2 | 5/2021 | Zhang et al. |
| 11,027,025 B2 | 6/2021 | Hoge et al. |
| 11,136,567 B2 | 10/2021 | Behlke et al. |
| 11,141,378 B2 | 10/2021 | Yaworski et al. |
| 11,142,750 B2 | 10/2021 | Smith et al. |
| 11,162,114 B2 | 11/2021 | Crawley et al. |
| 11,180,743 B2 | 11/2021 | Doudna et al. |
| 11,186,849 B2 | 11/2021 | Doudna et al. |
| 11,193,141 B2 | 12/2021 | Dever et al. |
| 11,236,359 B2 | 2/2022 | Mali et al. |
| 11,236,364 B2 | 2/2022 | May et al. |
| 11,268,092 B2 | 3/2022 | Lee et al. |
| 11,274,285 B2 | 3/2022 | Jantz et al. |
| 11,274,302 B2 | 3/2022 | Powell |
| 11,279,928 B2 | 3/2022 | Yin et al. |
| 11,306,305 B2 | 4/2022 | Gagnon et al. |
| 11,306,309 B2 | 4/2022 | Porteus et al. |
| 11,359,211 B2 | 6/2022 | Church et al. |
| 11,365,429 B2 | 6/2022 | Church et al. |
| 11,371,031 B2 | 6/2022 | Doudna et al. |
| 11,377,646 B2 | 7/2022 | Doudna et al. |
| 11,414,657 B2 | 8/2022 | Rahdar et al. |
| 11,441,137 B2 | 9/2022 | Doudna et al. |
| 11,453,864 B2 | 9/2022 | Sontheimer et al. |
| 11,453,866 B2 | 9/2022 | Doudna et al. |
| 11,459,559 B2 | 10/2022 | Collingwood et al. |
| 11,459,588 B2 | 10/2022 | May et al. |
| 11,479,767 B2 | 10/2022 | Smith et al. |
| 11,479,793 B2 | 10/2022 | Jin et al. |
| 11,492,646 B2 | 11/2022 | Dever et al. |
| 11,512,325 B2 | 11/2022 | Church et al. |
| 11,530,398 B2 | 12/2022 | Doudna et al. |
| 11,535,846 B2 | 12/2022 | Porteus et al. |
| 11,535,863 B2 | 12/2022 | Church et al. |
| 11,560,555 B2 | 1/2023 | Oakes et al. |
| 11,578,313 B2 | 2/2023 | Doudna et al. |
| 11,667,903 B2 | 6/2023 | Yeo et al. |
| 12,049,624 B2 | 7/2024 | Huang et al. |
| 2003/0068301 A1 | 4/2003 | Draper et al. |
| 2003/0206887 A1 | 11/2003 | Morrissey et al. |
| 2004/0054156 A1 | 3/2004 | Draper et al. |
| 2004/0127446 A1 | 7/2004 | Blatt et al. |
| 2006/0153826 A1 | 7/2006 | Arnould et al. |
| 2006/0223990 A1 | 10/2006 | Usman et al. |
| 2008/0207539 A1 | 8/2008 | Arbuthnot et al. |
| 2012/0171191 A1 | 7/2012 | Choulika et al. |
| 2012/0297495 A1 | 11/2012 | McCaffrey et al. |
| 2014/0342456 A1 | 11/2014 | Mali et al. |
| 2015/0059010 A1 | 2/2015 | Cigan et al. |
| 2015/0232833 A1 | 8/2015 | Mali et al. |
| 2015/0259704 A1 | 9/2015 | Church et al. |
| 2015/0315557 A1 | 11/2015 | Choulika et al. |
| 2016/0060655 A1 | 3/2016 | Quake et al. |
| 2016/0200779 A1 | 7/2016 | Liu et al. |
| 2016/0201072 A1 | 7/2016 | Cigan et al. |
| 2016/0208288 A1 | 7/2016 | Liu et al. |
| 2016/0273003 A1 | 9/2016 | Duchateau et al. |
| 2016/0298096 A1 | 10/2016 | Charpentier et al. |
| 2016/0317677 A1 | 11/2016 | Bhatia et al. |
| 2016/0355795 A1 | 12/2016 | Ran et al. |
| 2017/0044537 A1 | 2/2017 | Collingwood et al. |
| 2017/0087225 A1 | 3/2017 | Quake |
| 2017/0145394 A1 | 5/2017 | Yeo et al. |
| 2017/0191078 A1 | 7/2017 | Zhang et al. |
| 2017/0219596 A1 | 8/2017 | Tanenbaum et al. |
| 2017/0247690 A1 | 8/2017 | Quake et al. |
| 2017/0247703 A1 | 8/2017 | Sloan et al. |
| 2017/0321214 A1 | 11/2017 | Zhang et al. |
| 2018/0023064 A1 | 1/2018 | Gersbach et al. |
| 2018/0112213 A1 | 4/2018 | Welstead et al. |
| 2018/0142236 A1 | 5/2018 | He et al. |
| 2018/0148719 A1 | 5/2018 | Lee et al. |
| 2018/0179523 A1 | 6/2018 | Collingwood et al. |
| 2018/0187176 A1 | 7/2018 | Behlke et al. |
| 2018/0201921 A1 | 7/2018 | Malcolm |
| 2018/0208914 A1 | 7/2018 | Malcolm et al. |
| 2018/0236103 A1 | 8/2018 | Friedland et al. |
| 2018/0245074 A1 | 8/2018 | Lee et al. |
| 2018/0258411 A1 | 9/2018 | Kadiyala et al. |
| 2019/0010481 A1 | 1/2019 | Joung et al. |
| 2019/0024086 A1 | 1/2019 | Lande et al. |
| 2019/0032049 A1 | 1/2019 | Naldini et al. |
| 2019/0032053 A1 | 1/2019 | Ji et al. |
| 2019/0032088 A1 | 1/2019 | Duchateau et al. |
| 2019/0032090 A1 | 1/2019 | Quake et al. |
| 2019/0040370 A1 | 2/2019 | Yeo et al. |
| 2019/0048338 A1 | 2/2019 | Yin et al. |
| 2019/0071673 A1 | 3/2019 | Malcolm |
| 2019/0127713 A1 | 5/2019 | Gersbach et al. |
| 2019/0233805 A1 | 8/2019 | Segal et al. |
| 2019/0233814 A1 | 8/2019 | Zhang et al. |
| 2019/0233816 A1 | 8/2019 | Langer et al. |
| 2019/0241911 A1 | 8/2019 | Dong et al. |
| 2019/0300908 A1 | 10/2019 | Doudna et al. |
| 2019/0330621 A1 | 10/2019 | Powell |
| 2019/0336617 A1 | 11/2019 | Malcolm |
| 2019/0338315 A1 | 11/2019 | Malcolm et al. |
| 2019/0351070 A1 | 11/2019 | Cullen et al. |
| 2019/0359959 A1 | 11/2019 | Jaenisch et al. |
| 2019/0382751 A1 | 12/2019 | Radhar et al. |
| 2019/0390195 A1 | 12/2019 | Tondera et al. |
| 2020/0087640 A1 | 3/2020 | Doudna et al. |
| 2020/0095586 A1 | 3/2020 | Malcolm |
| 2020/0140896 A1 | 5/2020 | Renaud et al. |
| 2020/0255858 A1 | 8/2020 | Doudna et al. |
| 2020/0263186 A1 | 8/2020 | Barrangou et al. |
| 2020/0299689 A1 | 9/2020 | Lee |
| 2020/0308583 A1 | 10/2020 | Kim et al. |
| 2020/0308599 A1 | 10/2020 | Church et al. |
| 2020/0339980 A1 | 10/2020 | Dellinger et al. |
| 2020/0362369 A1 | 11/2020 | Zhang et al. |
| 2020/0385721 A1 | 12/2020 | Lee et al. |
| 2020/0389425 A1 | 12/2020 | Bhatia et al. |
| 2021/0017508 A1 | 1/2021 | Doudna et al. |
| 2021/0017518 A1 | 1/2021 | Morris et al. |
| 2021/0054371 A1 | 2/2021 | Zhong |
| 2021/0062224 A1 | 3/2021 | Doudna et al. |
| 2021/0079389 A1 | 3/2021 | Ryan et al. |
| 2021/0087568 A1 | 3/2021 | Smith et al. |
| 2021/0123046 A1 | 4/2021 | Huang et al. |
| 2021/0130850 A1 | 5/2021 | Joung et al. |
| 2021/0139870 A1 | 5/2021 | Duchateau |
| 2021/0139891 A1 | 5/2021 | Carlson-Stevermer et al. |
| 2021/0147922 A1 | 5/2021 | Urnov et al. |
| 2021/0180038 A1 | 6/2021 | Jantz et al. |
| 2021/0214724 A1 | 7/2021 | Choudhary et al. |
| 2021/0222164 A1 | 7/2021 | Choudhary et al. |
| 2021/0222165 A1 | 7/2021 | Zhong |

(56) References Cited

U.S. PATENT DOCUMENTS

| | | |
|---|---|---|
| 2021/0222193 A1 | 7/2021 | Church et al. |
| 2021/0238567 A1 | 8/2021 | Doudna et al. |
| 2021/0254038 A1 | 8/2021 | Doudna et al. |
| 2021/0277392 A1 | 9/2021 | Hubbard et al. |
| 2021/0301271 A1 | 9/2021 | Doudna et al. |
| 2021/0324356 A1 | 10/2021 | Doudna et al. |
| 2021/0324358 A1 | 10/2021 | Doudna et al. |
| 2021/0361779 A1 | 11/2021 | Zhang et al. |
| 2021/0363518 A1 | 11/2021 | Sontheimer et al. |
| 2021/0371847 A1 | 12/2021 | Urnov et al. |
| 2021/0388348 A1 | 12/2021 | Sontheimer et al. |
| 2021/0403888 A1 | 12/2021 | Doudna et al. |
| 2022/0002693 A1 | 1/2022 | Behlke et al. |
| 2022/0010339 A1 | 1/2022 | Zhang et al. |
| 2022/0025408 A1 | 1/2022 | Dever et al. |
| 2022/0056427 A1 | 2/2022 | Smith et al. |
| 2022/0090065 A1 | 3/2022 | Ahn et al. |
| 2022/0111079 A1 | 4/2022 | Hoge et al. |
| 2022/0119809 A1 | 4/2022 | Doyon |
| 2022/0177900 A1 | 6/2022 | Cigan et al. |
| 2022/0195403 A1 | 6/2022 | Wang et al. |
| 2022/0195426 A1 | 6/2022 | Porteus et al. |
| 2022/0195427 A1 | 6/2022 | Porteus et al. |
| 2022/0220508 A1 | 7/2022 | Oakes et al. |
| 2022/0243187 A1 | 8/2022 | Jantz et al. |
| 2022/0290177 A1 | 9/2022 | Malcolm |
| 2022/0306699 A1 | 9/2022 | Stamatoyannopoulos et al. |
| 2022/0340889 A1 | 10/2022 | Doudna et al. |
| 2022/0340934 A1 | 10/2022 | Lee et al. |
| 2022/0372483 A1 | 11/2022 | Alexander et al. |
| 2022/0402862 A1 | 12/2022 | Scully et al. |
| 2023/0002760 A1 | 1/2023 | Welstead et al. |
| 2023/0028178 A1 | 1/2023 | Doudna et al. |
| 2023/0031465 A1 | 2/2023 | Lape et al. |
| 2023/0048681 A1 | 2/2023 | Malcolm |
| 2023/0070861 A1 | 3/2023 | Smekalova et al. |
| 2023/0092393 A1 | 3/2023 | Ryan et al. |
| 2023/0105319 A1 | 4/2023 | Das et al. |
| 2023/0124880 A1 | 4/2023 | Oakes et al. |
| 2023/0132569 A1 | 5/2023 | Sontheimer et al. |
| 2023/0203480 A1 | 6/2023 | Morrissey et al. |
| 2023/0287400 A1 | 9/2023 | Smith et al. |
| 2023/0293645 A1 | 9/2023 | Lee et al. |
| 2024/0023855 A1 | 1/2024 | Patel et al. |
| 2024/0067968 A1 | 2/2024 | Cosgrove et al. |
| 2024/0067969 A1 | 2/2024 | Cosgrove et al. |
| 2024/0076678 A1 | 3/2024 | Maeder et al. |
| 2024/0132855 A1 | 4/2024 | Jaffe et al. |
| 2024/0382622 A1 | 11/2024 | Jaffe et al. |
| 2024/0398950 A1 | 12/2024 | Dumauthioz |

FOREIGN PATENT DOCUMENTS

| | | |
|---|---|---|
| EP | 1590468 A2 | 11/2005 |
| EP | 2435560 A2 | 4/2012 |
| EP | 2771468 B1 | 2/2015 |
| EP | 2784162 B1 | 4/2015 |
| EP | 2896697 B1 | 9/2015 |
| EP | 2970208 A2 | 1/2016 |
| EP | 3071695 A2 | 9/2016 |
| EP | 3107999 A2 | 12/2016 |
| EP | 3149170 A1 | 4/2017 |
| EP | 3149171 A1 | 4/2017 |
| EP | 3159407 A1 | 4/2017 |
| EP | 3227447 A1 | 10/2017 |
| EP | 3230452 A1 | 10/2017 |
| EP | 3250691 A1 | 12/2017 |
| EP | 3294880 A1 | 3/2018 |
| EP | 3313989 A1 | 5/2018 |
| EP | 3344771 A1 | 7/2018 |
| EP | 3347464 A1 | 7/2018 |
| EP | 3353309 A1 | 8/2018 |
| EP | 3356527 A1 | 8/2018 |
| EP | 3356528 A1 | 8/2018 |
| EP | 3365447 A1 | 8/2018 |
| EP | 3375877 A1 | 9/2018 |
| EP | 3420077 A1 | 1/2019 |
| EP | 2940140 B1 | 3/2019 |
| EP | 3463406 A1 | 4/2019 |
| EP | 3469084 A1 | 4/2019 |
| EP | 3473720 A1 | 4/2019 |
| EP | 2931891 B1 | 5/2019 |
| EP | 3036327 B1 | 5/2019 |
| EP | 3080261 B1 | 5/2019 |
| EP | 3545085 A1 | 10/2019 |
| EP | 3551757 A1 | 10/2019 |
| EP | 3553174 A1 | 10/2019 |
| EP | 3562942 A1 | 11/2019 |
| EP | 3574093 A1 | 12/2019 |
| EP | 3601568 A1 | 2/2020 |
| EP | 3144390 B1 | 3/2020 |
| EP | 3630975 A1 | 4/2020 |
| EP | 3638792 A1 | 4/2020 |
| EP | 3641785 A1 | 4/2020 |
| EP | 3645721 A1 | 5/2020 |
| EP | 3662061 A1 | 6/2020 |
| EP | 3692154 A1 | 8/2020 |
| EP | 3011031 B1 | 9/2020 |
| EP | 3704239 A1 | 9/2020 |
| EP | 3715461 A2 | 9/2020 |
| EP | 3202899 B1 | 10/2020 |
| EP | 3234133 B1 | 11/2020 |
| EP | 3752632 A1 | 12/2020 |
| EP | 3760719 A1 | 1/2021 |
| EP | 3765616 A1 | 1/2021 |
| EP | 3775187 A1 | 2/2021 |
| EP | 3781704 A1 | 2/2021 |
| EP | 3786296 A1 | 3/2021 |
| EP | 3230451 B1 | 4/2021 |
| EP | 3802828 A1 | 4/2021 |
| EP | 2946015 B1 | 5/2021 |
| EP | 3280803 B1 | 5/2021 |
| EP | 3814370 A2 | 5/2021 |
| EP | 3814493 A1 | 5/2021 |
| EP | 3814524 A1 | 5/2021 |
| EP | 3820503 A1 | 5/2021 |
| EP | 3852911 A2 | 7/2021 |
| EP | 3019619 B1 | 8/2021 |
| EP | 3274454 B1 | 8/2021 |
| EP | 3865586 A1 | 8/2021 |
| EP | 3889260 A1 | 10/2021 |
| EP | 3209783 B1 | 11/2021 |
| EP | 3919505 A1 | 12/2021 |
| EP | 3935156 A1 | 1/2022 |
| EP | 3957734 A1 | 2/2022 |
| EP | 3965832 A1 | 3/2022 |
| EP | 3971287 A1 | 3/2022 |
| EP | 3980533 A1 | 4/2022 |
| EP | 3985115 A1 | 4/2022 |
| EP | 3995584 A1 | 5/2022 |
| EP | 4019635 A1 | 6/2022 |
| EP | 3380613 B1 | 10/2022 |
| EP | 4069729 A1 | 10/2022 |
| EP | 4073249 A1 | 10/2022 |
| EP | 3420093 B1 | 11/2022 |
| EP | 4081533 A1 | 11/2022 |
| EP | 4095246 A1 | 11/2022 |
| EP | 3080259 B1 | 2/2023 |
| EP | 3526323 B1 | 3/2023 |
| EP | 4150091 A2 | 3/2023 |
| EP | 4163374 A1 | 4/2023 |
| EP | 4183876 A1 | 5/2023 |
| WO | WO-9323569 A1 | 11/1993 |
| WO | WO-03093473 A1 | 11/2003 |
| WO | WO-2004067753 A2 | 8/2004 |
| WO | WO-2005021751 A1 | 3/2005 |
| WO | WO-2008119000 A1 | 10/2008 |
| WO | WO-2010136841 A2 | 12/2010 |
| WO | WO-2010136981 A2 | 12/2010 |
| WO | WO-2013176772 A1 | 11/2013 |
| WO | WO-2014093712 A1 | 6/2014 |
| WO | WO-2014099744 A1 | 6/2014 |
| WO | WO-2014099750 A2 | 6/2014 |
| WO | WO-2014113493 A1 | 7/2014 |

(56) References Cited

FOREIGN PATENT DOCUMENTS

| | | |
|---|---|---|
| WO | WO-2014144761 A2 | 9/2014 |
| WO | WO-2014204014 A1 | 12/2014 |
| WO | WO-2014204729 A1 | 12/2014 |
| WO | WO-2015006747 A2 | 1/2015 |
| WO | WO-2015026885 A1 | 2/2015 |
| WO | WO-2015048690 A1 | 4/2015 |
| WO | WO-2015071474 A2 | 5/2015 |
| WO | WO-2015089465 A1 | 6/2015 |
| WO | WO-2015089473 A1 | 6/2015 |
| WO | WO-2015095340 A1 | 6/2015 |
| WO | WO-2015126927 A2 | 8/2015 |
| WO | WO-2015184259 A1 | 12/2015 |
| WO | WO-2015184262 A1 | 12/2015 |
| WO | WO-2015199952 A1 | 12/2015 |
| WO | WO-2016022866 A1 | 2/2016 |
| WO | WO-2016049258 A2 | 3/2016 |
| WO | WO-2016063264 A1 | 4/2016 |
| WO | WO-2016077321 A1 | 5/2016 |
| WO | WO-2016081029 A1 | 5/2016 |
| WO | WO-2016089433 A1 | 6/2016 |
| WO | WO-2016094867 A1 | 6/2016 |
| WO | WO-2016094872 A1 | 6/2016 |
| WO | WO-2016094874 A1 | 6/2016 |
| WO | WO-2016100951 A2 | 6/2016 |
| WO | WO-2016123230 A1 | 8/2016 |
| WO | WO-2016154596 A1 | 9/2016 |
| WO | WO-2016164356 A1 | 10/2016 |
| WO | WO-2016186745 A1 | 11/2016 |
| WO | WO-2016197132 A1 | 12/2016 |
| WO | WO-2016197133 A1 | 12/2016 |
| WO | WO-2017004261 A1 | 1/2017 |
| WO | WO-2017004279 A2 | 1/2017 |
| WO | WO-2017040511 A1 | 3/2017 |
| WO | WO-2017044419 A1 | 3/2017 |
| WO | WO-2017044776 A1 | 3/2017 |
| WO | WO-2017053713 A1 | 3/2017 |
| WO | WO-2017053729 A1 | 3/2017 |
| WO | WO-2017058795 A1 | 4/2017 |
| WO | WO-2017068377 A1 | 4/2017 |
| WO | WO-2017070284 A1 | 4/2017 |
| WO | WO-2017075531 A1 | 5/2017 |
| WO | WO-2017091630 A1 | 6/2017 |
| WO | WO-2017106657 A1 | 6/2017 |
| WO | WO-2017136794 A1 | 8/2017 |
| WO | WO-2017144630 A1 | 8/2017 |
| WO | WO-2017147446 A1 | 8/2017 |
| WO | WO-2017210380 A1 | 12/2017 |
| WO | WO-2017214460 A1 | 12/2017 |
| WO | WO-2018005873 A1 | 1/2018 |
| WO | WO-2018057946 A2 | 3/2018 |
| WO | WO-2018071849 A2 | 4/2018 |
| WO | WO-2018081480 A1 | 5/2018 |
| WO | WO-2018098383 A1 | 5/2018 |
| WO | WO-2018107028 A1 | 6/2018 |
| WO | WO-2018118585 A1 | 6/2018 |
| WO | WO-2018118586 A1 | 6/2018 |
| WO | WO-2018118587 A1 | 6/2018 |
| WO | WO-2018125964 A1 | 7/2018 |
| WO | WO-2018129293 A1 | 7/2018 |
| WO | WO-2018136396 A2 | 7/2018 |
| WO | WO-2018140269 A1 | 8/2018 |
| WO | WO-2018183808 A1 | 10/2018 |
| WO | WO-2018217981 A1 | 11/2018 |
| WO | WO-2018232114 A1 | 12/2018 |
| WO | WO-2018234239 A1 | 12/2018 |
| WO | WO-2019003193 A1 | 1/2019 |
| WO | WO-2019027728 A1 | 2/2019 |
| WO | WO-2019070762 A1 | 4/2019 |
| WO | WO-2019084664 A1 | 5/2019 |
| WO | WO-2019089820 A1 | 5/2019 |
| WO | WO-2019103442 A2 | 5/2019 |
| WO | WO-2019126037 A1 | 6/2019 |
| WO | WO-2019147275 A1 | 8/2019 |
| WO | WO-2019147743 A1 | 8/2019 |
| WO | WO-2019178428 A1 | 9/2019 |
| WO | WO-2019183000 A1 | 9/2019 |
| WO | WO-2019200247 A1 | 10/2019 |
| WO | WO-2019204661 A1 | 10/2019 |
| WO | WO-2019204766 A1 | 10/2019 |
| WO | WO-2019213039 A1 | 11/2019 |
| WO | WO-2019213062 A1 | 11/2019 |
| WO | WO-2019213776 A1 | 11/2019 |
| WO | WO-2019237069 A1 | 12/2019 |
| WO | WO-2020006126 A1 | 1/2020 |
| WO | WO-2020006131 A2 | 1/2020 |
| WO | WO-2020006132 A1 | 1/2020 |
| WO | WO-2020014577 A1 | 1/2020 |
| WO | WO-2020023529 A1 | 1/2020 |
| WO | WO-2020041456 A1 | 2/2020 |
| WO | WO-2020055941 A1 | 3/2020 |
| WO | WO-2020061426 A2 | 3/2020 |
| WO | WO-2020068643 A1 | 4/2020 |
| WO | WO-2020097360 A1 | 5/2020 |
| WO | WO-2020181101 A1 | 9/2020 |
| WO | WO-2020181178 A1 | 9/2020 |
| WO | WO-2020214003 A1 | 10/2020 |
| WO | WO-2020231863 A1 | 11/2020 |
| WO | WO-2020247882 A1 | 12/2020 |
| WO | WO-2021034373 A1 | 2/2021 |
| WO | WO-2021113765 A1 | 6/2021 |
| WO | WO-2021119275 A1 | 6/2021 |
| WO | WO-2021133829 A1 | 7/2021 |
| WO | WO-2021216772 A1 | 10/2021 |
| WO | WO-2021226077 A2 | 11/2021 |
| WO | WO-2021231606 A2 | 11/2021 |
| WO | WO-2021247570 A2 | 12/2021 |
| WO | WO-2022011232 A1 | 1/2022 |
| WO | WO-2022032397 A1 | 2/2022 |
| WO | WO-2022055998 A1 | 3/2022 |
| WO | WO-2022119919 A1 | 6/2022 |
| WO | WO-2022140572 A1 | 6/2022 |
| WO | WO-2022140577 A2 | 6/2022 |
| WO | WO-2022140776 A1 | 6/2022 |
| WO | WO-2022146654 A1 | 7/2022 |
| WO | WO-2022148955 A1 | 7/2022 |
| WO | WO-2022159822 A1 | 7/2022 |
| WO | WO-2022162247 A1 | 8/2022 |
| WO | WO-2022182801 A1 | 9/2022 |
| WO | WO-2022229851 A1 | 11/2022 |
| WO | WO-2022234519 A1 | 11/2022 |
| WO | WO-2022236147 A1 | 11/2022 |
| WO | WO-2022248454 A1 | 12/2022 |
| WO | WO-2022261292 A1 | 12/2022 |
| WO | WO-2023004375 A2 | 1/2023 |
| WO | WO-2023004409 A1 | 1/2023 |
| WO | WO-2023011638 A1 | 2/2023 |
| WO | WO-2023039586 A1 | 3/2023 |
| WO | WO-2023043856 A1 | 3/2023 |
| WO | WO-2023047338 A1 | 3/2023 |
| WO | WO-2023250183 A2 | 12/2023 |
| WO | WO-2023215711 A9 | 1/2024 |
| WO | WO-2024040254 A2 | 2/2024 |
| WO | WO-2024064910 A1 | 3/2024 |
| WO | WO-2024186896 A2 | 9/2024 |
| WO | WO-2024238700 A1 | 11/2024 |

OTHER PUBLICATIONS

Wristlock et al., (Quarterly Reviews of Biophysics 2003, vol. 36 (3): 307-340.*
Kwiatkowski et al., (Biochemistry 38:11643-11650, 1999.*
Kisselev L., (Structure, 2002, vol. 10: 8-9.*
Abraham, et al., The topology of hepatitis B virus pregenomic RNA promotes its replication, J. Virol., 81(21):11577-11584, (2007).
Akalin, A et al., MethylKit: a comprehensive R package for the analysis of genome-wide DNA methylation profiles, Genome Biol., vol. 13, 10 (2012).
Alerasool, N et al., An efficient KRAB domain for CRISPRi applications in human cells, Nature Methods, vol. 17, 11 (2020):1093-1096.
Altinel, et al., Single-Nucleotide Resolution Mapping of Hepatitis B Virus Promoters in Infected Human Livers and Hepatocellular Carcinoma, J Virol., 90(23):10811-10822, (2016).

(56) References Cited

OTHER PUBLICATIONS

Amabile, A et al., Inheritable Silencing of Endogenous Genes by Hit-and-Run Targeted Epigenetic Editing, Cell, vol. 167, (2016):219-232.e14.
Bae, S et al., Cas-OFFinder: a fast and versatile algorithm that searches for potential off-target sites of Cas9 RNA-guided endonucleases, Bioinformatics, vol. 30, (2014):1473-1475.
Bartel, M.A et al., Directed evolution of novel adeno-associated viruses for therapeutic gene delivery, Gene Therapy, vol. 19, (2012):694-700.
Batzer, Mark A et al. Enhanced Evolutionary PCR Using Oligonucleotides With Inosine At The 3'-Terminus. Nucleic Acids Research 19(18):5081 (1991).
Bloom, K et al., Inhibition of replication of hepatitis B virus using transcriptional repressors that target the viral Dna, Bmc Infectious Diseases, vol. 19, 1 (2019):802.
Carroll, D., Genome Engineering With Zinc-Finger Nucleases, Genet., vol. 188, 4 (2011):773-782.
Chen, B et al., Dynamic imaging of genomic loci in living human cells by an optimized CRISPR/Cas system, Cell, vol. 155, 7 (2013):1479-1491.
Chen, et al., Detection of hepatitis B virus DNA in hepatocellular carcinoma: methylation of integrated viral Dna, J Virol Methods., 19(3-4):257-263, (1988).
Chen, et al., Translation of the first upstream ORF in the hepatitis B virus pregenomic RNA modulates translation at the core and polymerase initiation codons, Nucleic Acids Res., 33(4):1169-1181, (2005).
Cheng, Q et al., Selective ORgan Targeting (SORT) nanoparticles for tissue specific mRNA delivery and CRISPR/Cas gene editing, Nat Nanotechnol., 15, (2020):313-320.
Christian, M et al., Targeting DNA Double-Strand Breaks with TAL Effector Nucleases, Genetics, vol. 186, 2 (2008):757-761.
Chylinski, K et al., The tracrRNA and Cas9 families of type II CRISPR-Cas immunity systems, RNA Biology, vol. 10, 5 (2013):726-737.
Cullis, Pieter R et al. Lipid Nanoparticle Systems for Enabling Gene Therapies. Molecular Therapy 25(7):1467-1475 (2017).
Dandri, M., Epigenetic modulation in chronic hepatitis B virus infection, Seminars in Immunopathology, vol. 42, 2 (2020): 173-185.
Dillard, S.A et al., Passive, active and endogenous organ-targeted lipid and polymer nanoparticles for delivery of genetic drugs, Nat Rev Mater, vol. 8, 4 (2023):282-300.
Ecco, G et al., KRAB zinc finger proteins, Development, vol. 144, 15 (2017):2719-2729.
Finn, J.D et al., A Single Administration of CRISPR/Cas9 Lipid Nanoparticles Achieves Robust and Persistent In Vivo Genome Editing, Cell Rep., vol. 22, 9 (2018):2227-2235.
Fu, Y. et al., Improving CRISPR-Cas nuclease specificity using truncated guide RNAs, Nat Biotechnol., vol. 32, 3 (2014):279-284.
Galibert, et al., Nucleotide sequence of the hepatitis B virus genome (subtype ayw) cloned in E. coli, Nature, 281(5733):646-650, (1979).
Gao, Feng, et al., DNA-guided Genome Editing using the Natronobacterium Gregoryi Argonaute, Nature Biotechnology 34(7):768-773 (2016).
Han, X et al., An ionizable lipid toolbox for RNA delivery, Nat Commun., 12, 7233 (2021).
Hatit, M.Z.C. et al., Species-dependent in vivo mRNA delivery and cellular responses to nanoparticles, Nat Nanotechnol., vol. 17, (2022):310-318.
Hirakawa, M. et al., Gene editing and CRISPR in the clinic: current and future perspectives, Biosci Rep., vol. 40, 4 (2020): BSR20200127.
Hong, X. et al., Epigenetic regulation of hepatitis B virus covalently closed circular DNA: Implications for epigenetic therapy against chronic hepatitis B, Hepatology (Baltimore, Md.), vol. 66, 6 (2017): 2066-2077.
Hou, et al., CpG islands of hepatitis B virus genome isolated from Chinese patients, Gene, 561:261-267, (2015).
Hou, Xucheng, et al., Lipid nanoparticles for mRNA delivery. Nature Reviews Materials 6:1078-1094 (2021).
International Preliminary Report on Patentability issued in PCT/US2021/064913, dated Jun. 13, 2023.
International Search Report and Written Opinion issued in PCT/US2021/064913, mailed Jul. 1, 2022.
International Search Report and Written Opinion issued in PCT/US2023/074931, mailed Feb. 13, 2024.
Isalan, M. et al., A rapid, generally applicable method to engineer zinc fingers illustrated by targeting the HIV-1 promoter, Nat Biotechnol., vol. 19, 7(2001):656-660.
Jain, et al., Comprehensive DNA methylation analysis of hepatitis B virus genome in infected liver tissues, Sci Rep., 5:10478, (2015).
Jinek, M et al., A Programmable Dual-RNA-Guided DNA Endonuclease in Adaptive Bacterial Immunity, Science, vol. 337, (2012):816-821.
Joung, J.K. et al., A bacterial two-hybrid selection system for studying protein-DNA and protein-protein interactions, PNAS, vol. 97, (2000):7382-7387.
Joung, J.K. et al., Reply to "Genome editing with modularly assembled zinc-finger nucleases", Nat. Methods, vol. 7, (2010):91-92.
Kasiewicz, L.S. et al., Lipid nanoparticles incorporating a GalNAc ligand enable in vivo liver ANGPTL3 editing in wild-type and somatic LDLR knockout non-human primates, bioRxiv, 2021.
Kazemian, et al., Lipid-Nanoparticle-Based Delivery of CRISPR/Cas9 Genome-Editing Components, Molecular Pharmaceutics, 19(6):1669-1686, (2022).
Kazemian, P. et al., Lipid-Nanoparticle-Based Delivery of CRISPR/Cas9 Genome-Editing Components, Molecular Pharmaceutics, vol. 19, 6 (2022):1669-1686.
Kleinstiver, B.J. et al., Broadening the targeting range of Staphylococcus aureus CRISPR-Cas9 by modifying PAM recognition, Nat. Biotechnol., vol. 33, (2015):1293-1298.
Kleinstiver, B.J. et al., Engineered CRISPR-Cas9 nucleases with altered PAM specificities, Nature vol. 523, 7561(2015):481-485.
Koblan, L.W. et al., Improving cytidine and adenine base editors by expression optimization and ancestral reconstruction, Nat. Biotechnol., vol. 36, 9 (2018):843-848.
Krueger, F. et al., Bismark: A flexible aligner and methylation caller for Bisulfite-Seq applications, Bioinformatics, vol. 27, 11 (2011):1571-1572.
Labun, K et al., CHOPCHOP v3: Expanding the CRISPR web toolbox beyond genome editing, Nucleic Acids Res., vol. 47, (2019):W171-W174.
Ladner, et al., Inducible expression of human hepatitis B virus (HBV) in stably transfected hepatoblastoma cells: a novel system for screening potential inhibitors of HBV replication, Antimicrob. Agents Chemother., 41(8):1715-1720, (1997).
Lam, et al., Optimizing Lipid Nanoparticles for Delivery in Primates, Adv. Materials, 35:2211420, (2023).
Lam, K et al., Unsaturated, Trialkyl Ionizable Lipids are Versatile Lipid-Nanoparticle Components for Therapeutic and Vaccine Applications, Adv.Mater, vol. 35, (2023).
Lambert, S.A. et al., The Human Transcription Factors, Cell, vol. 172, (2018):650-665.
Leibowitz, M. L. et al., Chromothripsis as an on-target consequence of CRISPR-Cas9 genome editing, Nat. Genet., vol. 53, 6 (2021):895-905.
Li, et al., MethPrimer: designing primers for methylation PCRs, Bioinformatics, 18(11):1427-1431, (2005).
Li, T. et al., TAL nucleases (TALNs): hybrid proteins composed of TAL effectors and FokI DNA-cleavage domain, Nucl Acids Res., vol. 39, 1 (2010):359-372.
Li, W. et al., Engineering and Selection of Shuffled AAV Genomes: A New Strategy for Producing Targeted Biological Nanoparticles, Mol Ther., vol. 16, 7 (2008):1252-1260.
Lombardo, A. et al., Gene editing in human stem cells using zinc finger nucleases and integrase-defective lentiviral vector delivery, Nat Biotechnol., vol. 25, 11 (2007):1298-1306.
Londono, J.R. et al., Genetic characterization and epigenetic interference to better understand and fight occult Hepatitis B virus infection, Ph.D. Thesis, (2017).

(56) References Cited

OTHER PUBLICATIONS

Luck, K. et al., A reference map of the human binary protein interactome, Nature, vol. 580, 7803 (2020):402-408.
Lyko, F., The DNA methyltransferase family: a versatile toolkit for epigenetic regulation, Nat Review, vol. 19, (2018):81-92.
Maeder, M.L. et al., Rapid "open-source" engineering of customized zinc-finger nucleases for highly efficient gene modification, Mol. Cell, vol. 31, (2008):294-301.
McClure, R.F. et al., Production and Titering of Recombinant Adeno-associated Viral Vectors, J Vis Exp., vol. 57, (2011):3378.
Meier-Stephenson, et al., Comprehensive Analysis of Hepatitis B Virus Promoter Region Mutations, Viruses, 10(11):603, (2018).
Micklefield, Jason. Backbone Modification of Nucleic Acids: Synthesis, Structure and Therapeutic Applications. Current Medicinal Chemistry 8(10):1157-1179 (2001).
Miller, et al., Compact organization of the hepatitis B virus genome, Hepatology, 9(2):322-327, (1989).
Miller, J.C. et al., An improved zinc-finger nuclease architecture for highly specific genome editing, Nat Biotechnol., vol. 25, 7 (2007):778-785.
Mitchell, M.J. et al., Engineering precision nanoparticles for drug delivery, Nat Rev Drug Discov., vol. 20, (2021):101-124.
Mitra, B. et al., Host functions used by hepatitis B virus to complete its life cycle: Implications for developing host-targeting agents to treat chronic hepatitis B, Antiviral Research, vol. 158 (2018): 185-198.
Mlambo, T. et al., Designer epigenome modifiers enable robust and sustained gene silencing in clinically relevant human cells, Nucleic Acids Res., vol. 46, 9 (2018):4456-4468.
Moscou, M.J. et al., A Simple Cipher Governs DNA Recognition by TAL Effectors, Science, vol. 326, 5959 (2009):1501.
Mouzannar, et al., The Post-Transcriptional Regulatory Element of Hepatitis B Virus: From Discovery to Therapy, Viruses, 16(4):528, (2024).
Nahmad, A.D. et al., Frequent aneuploidy in primary human T cells after CRISPR-Cas9 cleavage, Nat. Biotechnol., vol. 40, 12 (2022):1807-1813.
No Author, Easl clinical practice guidelines: management of chronic hepatitis B virus infection, J Hepatol., 57:167-185, (2012).
Nuñez, J.K. et al., Genome-wide programmable transcriptional memory by CRISPR-based epigenome editing, Cell, vol. 184, 9 (2021):2503-2519.e17.
Oakes, B.L. et al., CRISPR-Cas9 Circular Permutants as Programmable Scaffolds for Genome Modification, Cell, vol. 176, (2019):254-267.
Ohtsuka, Eiko. et al. An Alternative Approach to Deoxyoligonucleotides as Hybridization Probes by Insertion of Deoxyinosine at Ambiguous Codon Positions. Journal of Biological Chemistry 260(5):2605-2608 (1985).
Paschon, D.E. et al., Diversifying the structure of zinc finger nucleases for high-precision genome editing, Nat. Commun., vol. 10, 1133 (2019).
Paunovska, K. et al., Drug delivery systems for RNA therapeutics, Nat. Rev. Genet., vol. 23, (2022):265-280.
Pausch, Patrick et al. CRISPR-CasΦ from huge phages is a hypercompact genome editor. Science (New York, N.Y.) vol. 369,6501 (2020): 333-337. doi:10.1126/science.abb1400.
Peng, et al., Nonproductive Hepatitis B Virus Covalently Closed Circular DNA Generates HBx-Related Transcripts from the HBx/Enhancer I Region and Acquires Reactivation by Superinfection in Single Cells, J Virol., 97(1):e0171722, (2023).
Potter, M et al., A simplified purification protocol for recombinant adeno-associated virus vectors, Molecular Therapy—Methods & Clinical Development, vol. 1, (2014):14034.
Ray, K.K. et al., Two phase 3 trials of inclisiran in patients with elevated LDL cholesterol, N. Engl. J. Med., vol. 382, 16 (2020):1507-1519.
Rebar, E.J. et al., Zinc Finger Phage: Affinity Selection of Fingers with New DNA-Binding Specificities, Science, vol. 263, (1994):671-673.
Rees, H.A. et al., Analysis and minimization of cellular RNA editing by DNA adenine base editors, Sci. Adv., vol. 5, 1-11 (2019).
Rohner, E. et al., Unlocking the promise of mRNA therapeutics, Nat. Biotechnol., vol. 40, (2022):1586-1600.
Rossolini, Gian Maria et al. Use of Deoxyinosine-containing vVs Degenerate Primers for Polymerase Chain Reaction Based on Ambiguous Sequence Information. Molecular and Cellular Probes 8(2):91-98 (1994).
Schellenberger, V. et al., A recombinant polypeptide extends the in vivo half-life of peptides and proteins in a tunable manner, Nat Biotechnol., vol. 17, 1 (2009):1186-1190.
Singh, P. et al., Silencing hepatitis B virus covalently closed circular DNA: The potential of an epigenetic therapy approach, World Journal of Gastroenterology, vol. 27, 23 (2021): 3182-3207.
Stadelmayer, et al., Full-length 5'RACE identifies all major HBV transcripts in HBV-infected hepatocytes and patient serum, J Hepatol., 73(1):40-51, (2020).
Stadtmauer, E.A. et al., CRISPR- engineered T cells in patients with refractory cancer, Science, vol. 367, (2020):eaba7365.
Sternberg, Samuel H, et al., DNA Interrogation by the CRISPR RNA-Guided Endonuclease Cas9. Nature 507(7490):62-67 (2014).
Su, et al., Improving clinical outcomes of chronic hepatitis B virus infection, Expert Rev Gastroenterol Hepatol, 9:141-154, (2015).
Swarts, D.C. et al., Argonaute of the archaeon Pyrococcus furiosus is a DNA-guided nuclease that targets cognate DNA, Nucl. Acids Res., vol. 43, 10 (2015):5120-5129.
Swarts, D.C. et al., DNA-guided DNA interference by a prokaryotic Argonaute, Nature, vol. 507, 7491 (2014):258-261.
Tombacz, I. et al., Highly efficient CD4+ T cell targeting and genetic recombination using engineered CD4+ cell-homing mRNA-LNPs, Molecular Therapy, 29, 11 (2021):3293-3304.
Turchiano, G. et al., Quantitative evaluation of chromosomal rearrangements in gene-edited human stem cells by CAST-Seq, Cell Stem Cell, vol. 28, 6 (2021): 1136-1147.e5.
Tycko, J. et al., High-Throughput Discovery and Characterization of Human Transcriptional Effectors, Cell, vol. 183, 7 (2020):2020-2035.
U.S. Appl. No. 18/473,990 Office Action dated May 3, 2024.
Vanegas, K.G. et al., Cpf1 enables fast and efficient genome editing in Aspergilli, Fungal Biol Biotechnol., vol. 6, (2019):6.
Vivekanandan, et al., Hepatitis B viral DNA is methylated in liver tissues, J Viral Hepat., 15(2):103-107, (2007).
Ward, P. et al., Chimeric AAV Cap sequences alter gene transduction, Virology, vol. 386, 2 (2009):237-248.
Webber, B.R. et al., Highly efficient multiplex human T cell engineering without double-strand breaks using Cas9 base editors, Nat. Commun., vol. 10, 1 (2019):5222.
Weider, E. et al., Proprotein Convertase Subtilisin/Kexin Type 9 (PCSK9) Single Domain Antibodies Are Potent Inhibitors of Low Density Lipoprotein Receptor Degradation, J Biol Chem., vol. 291, 3 (2016):16659-71.
Wieland, et al., Interferon prevents formation of replication-competent hepatitis B virus RNA-containing nucleocapsids, PNAS, 102(28):9913-9917, (2005).
Wieland, et al., Intrahepatic induction of alpha/beta interferon eliminates viral RNA-containing capsids in hepatitis B virus transgenic mice, J Virol., 74(9):4165-4173, (2000).
Xia, Y. et al., Hepatitis B virus cccDNA: Formation, regulation and therapeutic potential, Antiviral Research, vol. 180 (2020): 104824.
Xirong, L. et al., Hepatitis B virus can be inhibited by DNA methyltransferase 3a via specific zinc-finger-induced methylation of the X promoter, Biochemistry. Biokhimiia, vol. 79, 2 (2014):111-23.
Yin, H. et al., Structure-guided chemical modification of guide RNA enables potent non-viral in vivo genome editing, Nat. Biotechnol., vol. 35, 12 (2017):1179-1187.
Zafra, M.P. et al., Optimized base editors enable efficient editing in cells, organoids and mice. Nat. Biotechnol., vol. 36, 9 (2018):888-896 (2018).
Zhang, et al., Comparative Analysis of CpG Islands among HBV Genotypes, PLOS ONE, 8(2):e56711, (2013).
Zhang, Y. et al., Lipids and Lipid Derivatives for RNA Delivery, Chemical Reviews, 121, 20 (2021).

(56) References Cited

OTHER PUBLICATIONS

Low, et al., Hepatitis B virus DNA methylation and its potential role in chronic hepatitis B, Expert Reviews in Molecular Medicine, 25:e11, (2023).
Yuen, et al., Hepatitis B virus infection, Nat Rev Dis Primers, 4(18035), (2018).
Borisova, et al., Structure and expression of the gene of the core antigen of human hepatitis B virus (HBV) in *Escherichia coli* cells, Dokl. Biochem., 279:386-390, (1985) (in Russian—concise explanation of the reference found on p. 88 of specification).
Buti, Maria. et al. Long-term safety and efficacy of nucleo(t) side analogue therapy in hepatitis B. Liver International 38(Suppl. 1):84-89 (2018).
Julio, Rendon Londono. Genetic characterizations and epigenetic interference to better understand and fight occult Hepatitis B virus infection. University of Groningen (pp. 1-280) (2017).
PCT/US2024/029529 International Search Report and Written Opinion dated Oct. 11, 2024.
U.S. Appl. No. 18/473,990 Office Action dated Aug. 22, 2024.
U.S. Appl. No. 18/762,301 Office Action dated Oct. 9, 2024.
Allen, Daniel et al. Using Synthetically Engineered Guide RNAs to Enhance CRISPR Genome Editing Systems in Mammalian Cells. Frontiers in Genome Editing 2:617910, 1-16 (2021).
Bloom, Kristie. et al. Gene Therapy for Chronic HBV-can we Eliminate cccDNA?. Genes 9(4):207, 1-15 (2018).
Brown, Wes et al. Regulating CRISPR/Cas9 Function through Conditional Guide RNA Control. ChemBioChem 22(1):63-72 (2021). Published Online Nov. 17, 2020.
Chen, Qiubing et al. Recent Advances in Chemical Modifications of Guide RNA, mRNA and Donor Template for CRISPR-mediated Genome Editing. Advanced Drug Delivery Reviews 168:246-258 (2021). Published Online Oct. 27, 2020.
Chroma Medicine Presents Data Demonstrating Near-Complete, Durable In Vivo Silencing with Targeted Epigenetic Editors at 2023 ASGCT Annual Meeting. BioSpace, May 18, 2023; [Retrieved on Jan. 20, 2025]. Available at URL:https://www.biospace.com/article/releases/chroma-medicine-presents-data-demonstrating-near-complete-durable-in-vivo-silencing-with-targeted-epigenetic-editors-at-2023-asgct-annual-meeting/ pp. 1-2.
Co-pending U.S. Appl. No. 18/981,846, inventors Friedland; Ari et al., filed on Dec. 16, 2024.
Co-pending U.S. Appl. No. 19/060,404, inventors Jaffe; Aron Brandon et al., filed on Feb. 21, 2025.
Gailhouste, Luc et al. Epigenetic reprogramming promotes the antiviral action of IFN alpha in HBV-infected cells. Cell Death Discovery 7(1):130, 1-11 (2021).
Gait, M J. Oligonucleotide Synthesis: A Practical Approach. IRL Press Limited (1984).
GenBank Accession No. XP_525483 Version No. XP_525483.2 Predicted: DNA (cytosine-5-)-methyltransferase 3-like [Pan troglodytes] pp. 1-2. Record created Sep. 16, 2006. Retrieved Feb. 7, 2025. Retrieved from: https://www.ncbi.nlm.nih.gov/protein/XP_525483.2?report=GenPept.
Hensel, Kai O. et al. Virus-host interplay in hepatitis B virus infection and epigenetic treatment strategies. The FEBS Journal 284(21):3550-3572 (2017).
Jeffries, Matlock A. Epigenetic editing: How cutting-edge targeted epigenetic modification might provide novel avenues for autoimmune disease therapy. Clinical Immunology 196:49-58 (2018).
Li, Fuyang et al. Chimeric DNA methyltransferases target DNA methylation to specific DNA sequences and repress expression of target genes. Nucleic acids research 35(1):100-112 (2007).
Ligat, Gaetan et al. Targeting Viral cccDNA for Cure of Chronic Hepatitis B. Current Hepatology Reports 19(3):235-244 (2020).
Lilley, David. M.J. et al. Dahlberg. Methods in Enzymology; DNA Structure Part A: Synthesis and Physical Analysis of DNA. Academic Press 211:1-5 (1992).
Lu, Juane et al. Types of Nuclear Localization Signals and Mechanisms of Protein Import into the Nucleus. Cell Communication Signal 19(1):60, 1-10 (2021).
Lyer, R P. et al. Modified Oligonucleotides-Synthesis, Properties And Applications. Current Opinion in Molecular Therapeutics 1(3):344-358 (1999).
PCT/US2023/026140 International Search Report and Written Opinion dated Jan. 9, 2024.
Riesenberg, Stephan et al. Improved gRNA Secondary Structures Allow Editing of Target Sites Resistant to CRISPR-Cas9 Cleavage. Nature Communications 13(1):489, 1-8 (2022).
Roe, et al. DNA Isolation and Sequencing: Essential Techniques. John Wiley & Sons, New York 1-4 (1996).
Shapiro, Jenny et al. Chemical Modification of Guide RNAs for Improved CRISPR Activity in CD34+ Human Hematopoietic Stem and Progenitor Cells. CRISPR Guide RNA Design: Methods and Protocols 2162:37-48 (2021).
UniProtKB Accession No. Q99ZW2. CRISPR-associated endonuclease Cas9/Csn1. Record created Jun. 1, 2001. May 30, 2024 at URL: https://www.uniprot.org/uniprotkb/Q99ZW2/entry pp. 1-8.
U.S. Appl. No. 18/762,301 Office Action dated Jan. 13, 2025.
Weitzman, Matthew D. et al. Adeno-associated Virus Biology. Methods in molecular biology (Clifton, N.J.) 807:1-23 (2011).
Zhu, Anjing et al. HBV cccDNA and Its Potential as a Therapeutic Target. Journal of Clinical and Translational Hepatology 7(3):258-262 (2019).

\* cited by examiner

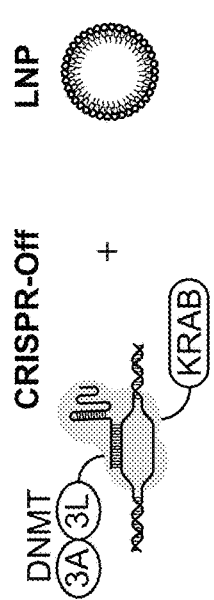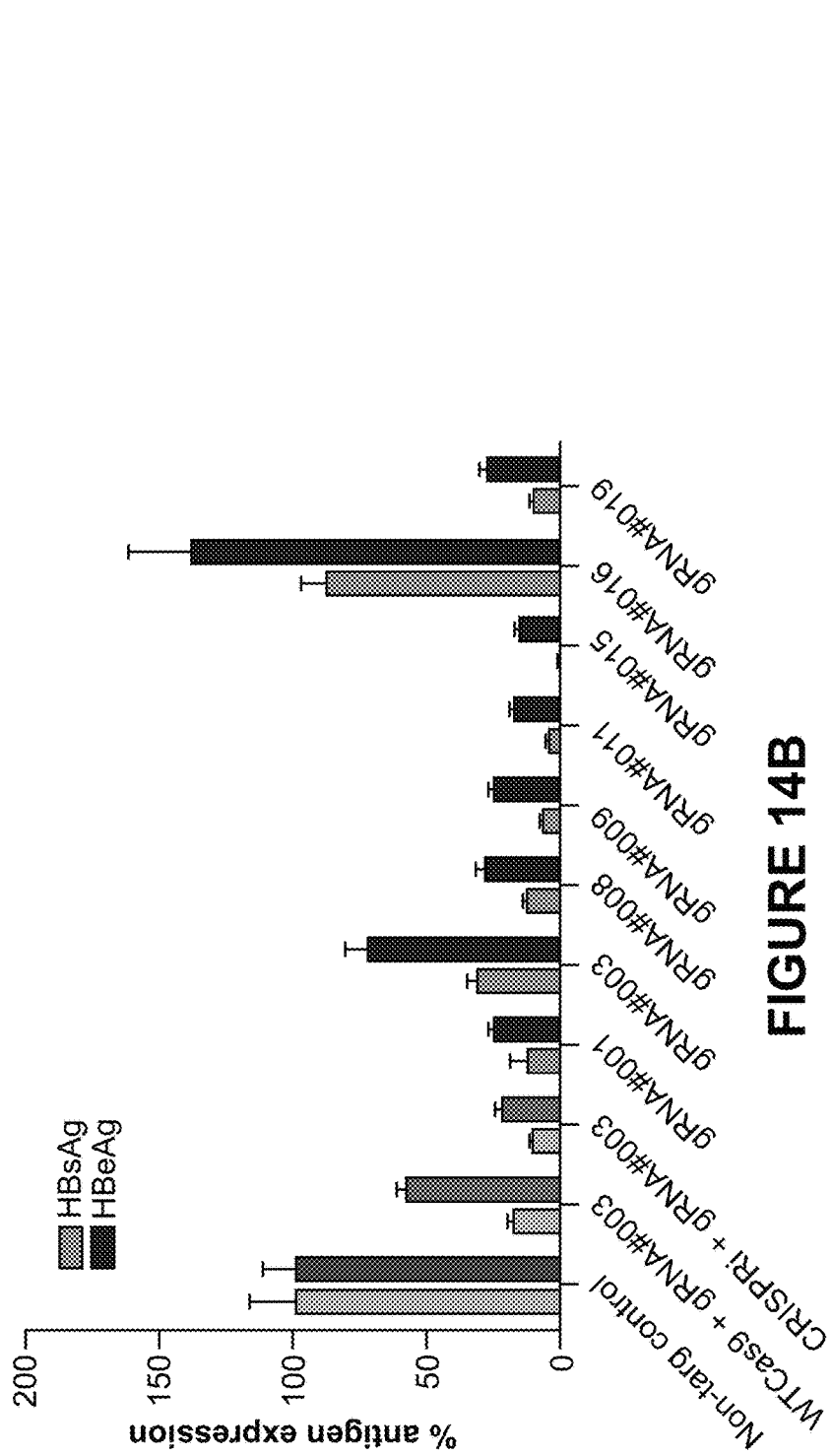
FIGURE 14A
FIGURE 14B

Single administration

COMPOSITIONS AND METHODS FOR EPIGENETIC REGULATION OF HBV GENE EXPRESSION

CROSS-REFERENCE

This application is a continuation of International Application No. PCT/US2024/029529, filed on May 15, 2024, which claims the benefit of U.S. Provisional Application No. 63/502,325, filed May 15, 2023, U.S. Provisional Application No. 63/516,096, filed Jul. 27, 2023, and U.S. Provisional Application No. 63/581,236, filed Sep. 7, 2023, each of which is incorporated herein by reference in its entirety.

SEQUENCE LISTING

The instant application contains a Sequence Listing which has been submitted electronically in XML file format and is hereby incorporated by reference in its entirety. Said XML copy, created on Jul. 11, 2024, is named 59073-720.602_SL.xml and is 1,435,558 bytes in size.

BACKGROUND OF THE INVENTION

Despite available treatments, chronic hepatitis B (CHB) remains a high unmet medical need, with more than 250 million carriers of hepatitis B virus (HBV) worldwide and approximately 800,000 annual deaths due to HBV-related liver disease. Current approved CHB therapies elicit a functional cure rate (defined as durable HBsAg loss and undetectable serum HBV after completing a course of treatment) of less than 20%. Accordingly, there is a need for improved clinical modalities targeting HBV.

SUMMARY OF THE INVENTION

Some aspects of the present disclosure provide systems, compositions, strategies, and methods for the epigenetic modification of HBV, including HBV in host cells and organisms.

Some aspects of this disclosure provide methods of modifying an epigenetic state of a hepatitis B virus (HBV) gene or genome, comprising contacting the HBV gene or genome with an epigenetic editing system, wherein the epigenetic editing system comprises a first DNA binding domain, a first DNMT domain, and a transcriptional repressor domain or one or more nucleic acid molecules encoding thereof, optionally, wherein the first DNA binding domain binds a first target region of the HBV gene or genome, and wherein the contacting results in a reduction of: number of HBV viral episomes, replication of the HBV gene or genome, and/or expression of a protein product encoded by the HBV gene or genome, wherein said reduction is at least about 20% compared to contacting the HBV gene or genome with a suitable control or without contacting the HBV gene or genome with the epigenetic editing system, and/or wherein said reduction of the number of HBV viral episomes, of replication of the HBV gene or genome, or of expression of a protein product encoded by the HBV gene or genome is at least 20%, at least 60%, at least 70%, at least 80%, at least 90% (i.e., at least a 1-log reduction), at least 95%, at least 99% (i.e., at least a 2-log reduction), or at least 99.9% (i.e., at least a 3-log reduction), compared to the number, replication, and/or expression in the subject before the contacting.

Some aspects of this disclosure provide methods of treating an HBV infection in a subject comprising administering an epigenetic editing system to the subject, wherein the epigenetic editing system comprises a first DNA binding domain, a first DNMT domain, and a transcriptional repressor domain or one or more nucleic acid molecules encoding thereof, optionally, wherein the first DNA binding domain binds a first target region of a HBV gene or genome, and wherein the administering results in a reduction of: number of HBV viral episomes, replication of the HBV gene or genome, and/or expression of a protein product encoded by the HBV gene or genome, wherein said reduction is at least about 20% compared to administering a suitable control or without administering the epigenetic editing system, and/or wherein said reduction of the number of HBV viral episomes, of replication of the HBV gene or genome, or of expression of a protein product encoded by the HBV gene or genome is at least 20%, at least 60%, at least 70%, at least 80%, at least 90%, at least 95%, at least 99%, or at least 99.9%, compared to the number, replication, and/or expression in the subject before administering.

Some aspects of this disclosure provide methods of modulating expression of an HBV gene or genome comprising contacting the HBV gene or genome with an epigenetic editing system, wherein the epigenetic editing system comprises a first DNA binding domain, a first DNMT domain, and a transcriptional repressor domain or one or more nucleic acid molecules encoding thereof, wherein the first DNA binding domain binds a first target region of the HBV gene or genome, and wherein the contacting results in a reduction of expression of a gene product encoded by the HBV gene or genome, optionally, wherein the gene product is a nucleic acid or a protein, wherein said reduction is at least about 20% compared to contacting the HBV genome with a suitable control or without contacting the HBV gene or genome with the epigenetic editing system, and/or wherein said reduction of the number of HBV viral episomes, of replication of the HBV gene or genome, or of expression of a protein product encoded by the HBV gene or genome is at least 20%, at least 60%, at least 70%, at least 80%, at least 90%, at least 95%, at least 99%, or at least 99.9%, compared to the number, replication, and/or expression in the subject before the contacting.

Some aspects of this disclosure provide methods of inhibiting viral replication in a cell infected with an HBV comprising contacting the cell with an epigenetic editing system, wherein the epigenetic editing system comprises a first DNA binding domain, a first DNMT domain, and a transcriptional repressor domain or one or more nucleic acid molecules encoding thereof, optionally, wherein the first DNA binding domain binds a first target region of a HBV gene or genome, and wherein the epigenetic editing system targets a target region of the HBV gene or genome, and wherein the contacting results in a reduction of number of HBV viral episomes or replication of the HBV gene or genome, wherein said reduction is at least about 20% compared to administering a suitable control or without contacting the HBV gene or genome with the epigenetic editing system, and/or wherein said reduction of the number of HBV viral episomes, of replication of the HBV gene or genome, or of expression of a protein product encoded by the HBV gene or genome is at least 20%, at least 60%, at least 70%, at least 80%, at least 90%, at least 95%, at least 99%, or at least 99.9%, compared to the number, replication, and/or expression in the subject before the contacting.

Some aspects of this disclosure provide methods comprising administering an epigenetic editing system to a subject in need thereof, wherein the epigenetic editing system comprises a first DNA binding domain, a first DNMT domain, and a transcriptional repressor domain or one or more nucleic acid molecules encoding thereof, wherein the first DNA binding domain binds a first target region of a HBV gene or genome, and wherein the contacting results in a reduction of: number of HBV viral episomes, replication of the HBV gene or genome, or expression of a protein product encoded by the HBV gene or genome, wherein said reduction is at least about 20% compared to administering a suitable control, and/or wherein said reduction of the number of HBV viral episomes, of replication of the HBV gene or genome, or of expression of a protein product encoded by the HBV gene or genome is at least about 20% compared to the number, replication, and/or expression in the subject before administering.

Some aspects of this disclosure provide methods of inhibiting viral replication in a subject infected with an HBV comprising administering an epigenetic editing system to the subject, wherein the epigenetic editing system comprises a first DNA binding domain, a first DNMT domain, and a transcriptional repressor domain or one or more nucleic acid molecules encoding thereof, wherein the epigenetic editing system targets a target region of the HBV gene or genome, and wherein the administering results in a reduction of number of HBV viral episomes, replication of the HBV gene or genome, or expression of a protein product encoded by an HBV gene or genome, wherein the reduction is at least about 20% compared to administering a suitable control or without administering the epigenetic editing system. In some embodiments, the reduction is at least 20%, at least 30%, at least 40%, at least 50%, at least 60%, at least 70%, at least 80%, at least 90%, at least 95%, at least 99%, or at least 99.9% compared to administering a suitable control or compared to the respective number or level in the subject before the administering. In some embodiments, the reduction is maintained for at least 6 days, for at least 19 days, for at least 27 days, for at least 42 days, or for at least 168 days.

In some embodiments, the contacting further results in a reduction of a protein product. In some embodiments, the protein product comprises an HBV antigen, for example an HBe antigen (HBeAg). In some embodiments, the protein product comprises an HBs antigen (HBsAg).

In some embodiments, the HBV genome is a covalently closed circular DNA (cccDNA) or an HBV integrated DNA. In some embodiments, the HBV genome comprises HBV genotype A, HBV genotype B, HBV genotype C, HBV genotype D, HBV genotype E, HBV genotype F, HBV genotype G or HBV genotype H. In some embodiments, the HBV genome comprises a sequence with at least 80% identity to an HBV genome sequence provided herein. In some embodiments, the first target region is located in a region of the HBV genome within nucleotide 0-303, 1000-2448 or 2802-3182 of an HBV genome provided herein. In some embodiments, the first target region of the HBV genome is located in a CpG island. In some embodiments, the first target region of the HBV genome is located in a promotor. In some embodiments, the first target region of the HBV genome is located in a section of the HBV genome that encodes a transcript selected from the group consisting of a pgRNA, a preCore mRNA, a preS mRNA, a S mRNA, and a X mRNA. In some embodiments, the first DNA binding domain comprises a CRISPR-Cas protein. In some embodiments, the epigenetic editing system further comprises a first guide RNA (gRNA) that comprises a region complementary to a strand of the first target region. In some embodiments, the gRNA comprises a sequence selected from a gRNA provided herein, e.g., in Table 12 or 13. In some embodiments, the first DNA binding domain comprises a zinc-finger protein. In some embodiments, the zinc-finger protein comprises a zinc-finger motif with a sequence selected from any zinc finger or zinc finger motif provided herein, e.g., in Table 1. In some embodiments, the zinc-finger protein comprises a sequence of any of the zinc finger epigenetic repressors provided herein. In some embodiments, the transcriptional repressor domain comprises ZIM3 In some embodiments, the first DNMT domain is a DNMT3A domain or a DNMT3L domain. In some embodiments, the first DNMT domain comprises a sequence of a DNMT domain provided herein. In some embodiments, the epigenetic editing system further comprises a second DNMT domain or a nucleic acid encoding thereof. In some embodiments, the second DNMT domain is a DNMT3A domain or a DNMT3L domain. In some embodiments, the second DNMT domain comprises a sequence of a DNMT domain provided herein. In some embodiments, the epigenetic editing system comprises a fusion protein or a nucleic acid encoding thereof, and wherein the fusion protein comprises the first DNA binding domain, the first DNMT domain, the repressor domain and the second DNMT domain. In some embodiments, the fusion protein further comprises a nuclear localization sequence (NLS). In some embodiments, the fusion protein comprises a sequence of a fusion protein provided herein. In some embodiments, the epigenetic editing system further comprises a second DNA binding domain or a nucleic acid encoding thereof, wherein the second DNA binding domain binds a second target region of the HBV genome. In some embodiments, the second target region is located in a region of the HBV genome within nucleotide 0-303, 1000-2448 or 2802-3182. In some embodiments, the second target region of the HBV genome is located in a CpG island. In some embodiments, the second target region of the HBV genome is located in a promotor. In some embodiments, the second target region of the HBV genome is located in a section of the HBV genome that encodes a transcript selected from the group consisting of a pgRNA, a preCore mRNA, a preS mRNA, a S mRNA, and a X mRNA. In some embodiments, the second DNA binding domain comprises a CRISPR-Cas protein. In some embodiments, the epigenetic editing system further comprises a second gRNA that comprises a region complementary to a strand of the second target region. In some embodiments, the gRNA comprises a sequence selected from a gRNA sequence provided herein, e.g., a sequence provided in Table 12 or 13. In some embodiments, the second DNA binding domain comprises a zinc-finger protein. In some embodiments, the zinc-finger protein comprises a zinc-finger motif with a sequence selected from a zinc finger motif sequence provided herein, e.g., a zinc finger motif provided in Table 1. In some embodiments, the zinc-finger protein comprises a sequence of a zinc finger motif provided in Table 1. In some embodiments, the epigenetic editing system comprises a first fusion protein or a first nucleic acid encoding thereof and a second fusion protein or a second nucleic acid encoding thereof, wherein the first fusion protein comprises the first DNA binding domain and the first DNMT domain, and wherein the second fusion protein comprises the second DNA binding domain and the transcriptional repressor domain. In some embodiments, the first fusion protein comprises a sequence of a fusion protein provided herein. In some embodiments, the second fusion protein comprises a sequence of a fusion protein provided herein. In some embodiments, the epigenetic editing system further comprises a third DNA binding domain or a nucleic acid encoding thereof, wherein the third DNA binding domain binds to a third target region of the HBV genome. In some embodiments, the third target region is located in a region of the HBV genome within nucleotide 0-303, 1000-2448 or 2802-3182. In some embodiments, the third target region of the HBV genome is located in a CpG island. In some embodiments, the third target region of the HBV genome is located in a promotor. In some embodiments, the third target region of the HBV genome is located in a section of the HBV genome that encodes a transcript selected from the group consisting of a pgRNA, a preCore mRNA, a preS mRNA, a S mRNA, and a X mRNA. In some embodiments, the third DNA binding domain comprises a CRISPR-Cas protein. In some embodiments, the epigenetic editing system further comprises a third gRNA that comprises a region complementary to a strand of the third target region. In some embodiments, the third gRNA comprises a sequence selected from a gRNA sequence provided herein, e.g., of a gRNA sequence provided in Table 12 or 13. In some embodiments, the third DNA binding domain comprises a zinc-finger protein. In some embodiments, the zinc-finger protein comprises a zinc-finger motif with a sequence selected from a zinc finger motif provided herein. In some embodiments, the zinc-finger protein comprises a sequence of a zinc finger motif provided in Table 1. In some embodiments, the epigenetic editing system further comprises a second DNMT domain or a nucleic acid encoding thereof. In some embodiments, the second DNMT domain is a DNMT3A domain or a DNMT3L domain. In some embodiments, the epigenetic editing system comprises a third fusion protein or a nucleic acid encoding thereof, wherein the third fusion protein comprises the third DNA binding domain and the second DNMT domain. In some embodiments, the third fusion protein comprises a sequence of a fusion protein provided herein. In some embodiments, the epigenetic editing system comprises a nucleic acid sequence provided in Table 18. In some embodiments, the reduction of the number of HBV viral episomes, of replication of the HBV gene or genome, or of expression of a protein product encoded by the HBV gene or genome is at least about 20% compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject. In some embodiments, the reduction of the number of HBV viral episomes, of replication of the HBV gene or genome, or of expression of a protein product encoded by the HBV gene or genome is at least about 25%, at least about 50%, at least about 75%, at least about 80%, at least about 90%, at least about 95%, at least about 99%, at least about 99.5%, at least about 99.8%, at least about 99.9%, at least about 99.95%, at least about 99.99%, or more than 99.99%, compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject.

Some aspects of this disclosure provide epigenetic editing systems comprising: a fusion protein or a nucleic acid encoding the fusion protein, wherein the fusion protein comprises: (a) a DNA-binding domain that binds a target region of a HBV gene or genome, (b) a first DNA methyltransferase (DNMT) domain, and (c) a transcriptional repressor domain. In some embodiments, the epigenetic editing system is capable of reducing a number of the HBV viral episome, replication of the HBV, or expression of a gene product encoded by the HBV gene or genome, wherein said reduction is at least about 20% compared to contacting the HBV gene or genome with a suitable control. In some embodiments, the HBV genome is a covalently closed circular DNA (cccDNA) or an HBV integrated DNA. In some embodiments, the HBV genome comprises HBV genotype A, HBV genotype B, HBV genotype C, HBV genotype D, HBV genotype E, HBV genotype F, HBV genotype G or HBV genotype H. In some embodiments, the HBV genome comprises a sequence with at least 80% identity to an HBV genome sequence provided herein. In some embodiments, the target region is located in a region of the HBV genome within nucleotide 0-303, 1000-2448 or 2802-3182 of an HBV genome sequence provided herein. In some embodiments, the target region of the HBV genome is located in a CpG island. In some embodiments, the target region of the HBV genome is located in a promotor. In some embodiments, the target region of the HBV genome is located in a section of the HBV genome that encodes a transcript selected from the group consisting of a pgRNA, a preCore mRNA, a preS mRNA, a S mRNA, and a X mRNA. In some embodiments, the DNA binding domain comprises a CRISPR-Cas protein. In some embodiments, the epigenetic editing system further comprises a gRNA that comprises a region complementary to a strand of the target region. In some embodiments, the gRNA comprises a sequence selected from a gRNA sequence provided herein, e.g., in Table 12 or 13. In some embodiments, the DNA binding domain comprises a zinc-finger protein. In some embodiments, the zinc-finger protein comprises a zinc-finger motif with a sequence selected from a zinc finger motif provided herein. In some embodiments, the zinc-finger protein comprises a sequence of a zinc finger motif provided in Table 1. In some embodiments, the transcriptional repressor domain comprises a sequence of a transcriptional repressor provided herein. In some embodiments, the first DNMT domain is a DNMT3A domain or a DNMT3L domain. In some embodiments, the DNMT domain comprises a sequence of a DNMT domain provided herein. In some embodiments, the fusion protein further comprises a second DNMT domain. In some embodiments, the second DNMT domain is a DNMT3A domain or a DNMT3L domain. In some embodiments, the fusion protein further comprises a nuclear localization sequence (NLS). In some embodiments, the fusion protein comprises a sequence of a fusion protein provided herein.

Some aspects of the present disclosure provide epigenetic editing systems comprising: a first fusion protein or a nucleic acid encoding the first fusion protein, wherein the first fusion protein comprises a first DNA binding domain and a first DNMT domain, wherein the first DNA binding domain binds a first target region of a HBV genome, and a second fusion protein or a nucleic acid encoding the second fusion protein, wherein the second fusion protein comprises a second DNA binding domain and a transcriptional repressor domain, wherein the second DNA binding domain binds a second target region of the HBV genome. In some embodiments, the epigenetic editing system is capable of reducing a number of the HBV viral episome, replication of the HBV, or expression of a gene product encoded by the HBV genome, wherein said reduction is at least about 20% compared to contacting the HBV genome with a suitable control. In some embodiments, the HBV genome is a covalently closed circular DNA (cccDNA) or an HBV integrated DNA. In some embodiments, the HBV genome comprises HBV genotype A, HBV genotype B, HBV genotype C, HBV genotype D, HBV genotype E, HBV genotype F, HBV genotype G or HBV genotype H In some embodiments, the HBV genome comprises a sequence with at least 80% identity to an HBV genome provided herein. In some embodiments, the epigenetic editing system further comprises a third fusion protein or a nucleic acid encoding the third fusion protein, wherein the third fusion protein comprises a third DNA binding domain and a second DNMT domain, wherein the third DNA binding domain binds a third target region of the HBV genome. In some embodiments, the first target region, the second target region or the third target region is located in a region of the HBV genome within nucleotide 0-303, 1000-2448 or 2802-3182 of an HBV genome provided herein. In some embodiments, the first target region, the second target region or the third target region of the HBV genome is located in a CpG island In some embodiments, the first target region, the second target region or the third target region of the HBV genome is located in a promotor In some embodiments, the first target region, the second target region or the third target region of the HBV genome is located in a section of the HBV genome that encodes a transcript selected from the group consisting of a pgRNA, a preCore mRNA, a preS mRNA, a S mRNA, and a X mRNA In some embodiments, the first DNA binding domain, the second DNA binding domain or the third DNA binding domain comprises a CRISPR-Cas protein. In some embodiments, the epigenetic editing system further comprises a first gRNA that comprises a region complementary to a strand of the first target region, a second gRNA that comprises a region complementary to a strand of the second target region or a third RNA that comprises a region complementary to a strand of the third target region. In some embodiments, the first gRNA comprises a sequence selected from a gRNA sequence provided herein, e.g., provided in Table 12 or 13, the second gRNA comprises a sequence selected from a gRNA sequence provided herein, e.g., provided in Table 12 or 13, and/or the third gRNA comprises a sequence selected from a gRNA sequence provided herein, e.g., provided in Table 12 or 13. In some embodiments, the first DNA binding domain, the second DNA binding domain or the third DNA binding domain comprises a zinc-finger protein In some embodiments, the zinc-finger protein comprises a zinc-finger motif with a sequence selected from a zinc finger motif provided herein In some embodiments, the zinc-finger protein comprises a sequence of a zinc finger motif provided in Table 1. In some embodiments, the transcriptional repressor domain comprises ZIM3. In some embodiments, the first DNMT domain is a DNMT3A domain or a DNMT3L domain. In some embodiments, the first DNMT domain comprises a sequence of a DNMT provided herein. In some embodiments, the second DNMT domain is a DNMT3A domain or a DNMT3L domain. In some embodiments, the second DNMT domain comprises a sequence of a DNMT domain provided herein. In some embodiments, the first fusion protein comprises a sequence of a fusion protein provided herein. In some embodiments, the second fusion protein comprises a sequence of a fusion protein provided herein. In some embodiments, the third fusion protein comprises a sequence of a fusion protein provided herein. In some embodiments, the epigenetic editing system comprises a nucleic acid sequence provided in Table 18. In some embodiments, the reduction of the number of HBV viral episomes, of replication of the HBV gene or genome, or of expression of a protein product encoded by the HBV gene or genome is at least about 20% compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject. In some embodiments, the reduction of the number of HBV viral episomes, of replication of the HBV gene or genome, or of expression of a protein product encoded by the HBV gene or genome is at least about 25%, at least about 50%, at least about 75%, at least about 80%, at least about 90%, at least about 95%, at least about 99%, at least about 99.5%, at least about 99.8%, at least about 99.9%, at least about 99.95%, at least about 99.99%, or more than 99.99%, compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject.

Some aspects of the present disclosure provide a method of treating an HDV infection in a subject comprising administering an epigenetic editing system to the subject, wherein the epigenetic editing system comprises a first DNA binding domain, a first DNMT domain, and a transcriptional repressor domain or one or more nucleic acid molecules encoding thereof, wherein the first DNA binding domain binds a first target region of a HBV gene or genome, and wherein the contacting results in a reduction of: number of HDV viral episomes, replication of the HDV gene or genome, or expression of a protein product encoded by the HDV gene or genome, wherein said reduction is at least about 20% compared to administering a suitable control. Some aspects of the present disclosure provide a method of inhibiting viral replication in a cell infected with an HDV comprising administering an epigenetic editing system, wherein the epigenetic editing system comprises a first DNA binding domain, a first DNMT domain, and a transcriptional repressor domain or one or more nucleic acid molecules encoding thereof, wherein the first DNA binding domain binds a first target region of a HBV gene or genome, and wherein the epigenetic editing system targets a target region of the HBV gene or genome, and wherein the contacting results in a reduction of number of HDV viral episomes or replication of the HDV gene or genome, wherein said reduction is at least about 20% compared to administering a suitable control. In some embodiments, the first DNA binding domain comprises a CRISPR-Cas protein. In some embodiments, the epigenetic editing system further comprises a first guide RNA (gRNA) that comprises a region complementary to a strand of the first target region. In some embodiments, the gRNA comprises a sequence selected from a gRNA provided herein, e.g., in Table 12 and/or 13. In some embodiments, the first DNA binding domain comprises a zinc-finger protein. In some embodiments, the zinc-finger protein comprises a zinc-finger motif with a sequence selected from any zinc finger or zinc finger motif provided herein, e.g., in Table 1 or Table 18. In some embodiments, the zinc-finger protein comprises a sequence of any of the zinc finger epigenetic repressors provided herein. In some embodiments, the transcriptional repressor domain comprises ZIM3. In some embodiments, the first DNMT domain is a DNMT3A domain or a DNMT3L domain. In some embodiments, the first DNMT domain comprises a sequence of a DNMT domain provided herein. In some embodiments, the epigenetic editing system further comprises a second DNMT domain or a nucleic acid encoding thereof. In some embodiments, the second DNMT domain is a DNMT3A domain or a DNMT3L domain. In some embodiments, the second DNMT domain comprises a sequence of a DNMT domain provided herein. In some embodiments, the epigenetic editing system comprises a fusion protein or a nucleic acid encoding thereof, and wherein the fusion protein comprises the first DNA binding domain, the first DNMT domain, the repressor domain and the second DNMT domain. In some embodiments, the fusion protein further comprises a nuclear localization sequence (NLS). In some embodiments, the fusion protein comprises a sequence of a fusion protein provided herein. In some embodiments, the first DNA binding domain binds a target region of an HBV gene or genome encoding or controlling expression of an S-antigen. In some embodiments, the epigenetic editing system comprises a nucleic acid sequence provided in Table 18. In some embodiments, the reduction of the number of HBV viral episomes, of replication of the HBV gene or genome, or of expression of a protein product encoded by the HBV gene or genome is at least about 20% compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject. In some embodiments, the reduction of the number of HBV viral episomes, of replication of the HBV gene or genome, or of expression of a protein product encoded by the HBV gene or genome is at least about 25%, at least about 50%, at least about 75%, at least about 80%, at least about 90%, at least about 95%, at least about 99%, at least about 99.5%, at least about 99.8%, at least about 99.9%, at least about 99.95%, at least about 99.99%, or more than 99.99%, compared to the number of HBV viral episomes, of replication of the HBV gene or genome, or of expression of a protein product encoded by the HBV gene or genome measured or observed before contacting the HBV genome with the epigenetic editing system, or before administering the epigenetic editing system to the subject.

Some aspects of this disclosure provide methods comprising administering an epigenetic editing system to a subject characterized by the presence of detectable levels of HBV DNA, HBsAg, and/or HBeAg in the plasma of the subject, for example, a subject having a chronic HBV infection. In some such embodiments, the epigenetic editing system comprises a first DNA binding domain, a first DNMT domain, and a transcriptional repressor domain or one or more nucleic acid molecules encoding the same, wherein the first DNA binding domain binds a first target region of an HBV gene or genome, and the administering results in a reduction of the level of HBV DNA, the level of HBsAg, and/or the level of HBsAg in the plasma of the subject, and the reduction of the level of HBV DNA, of the level of HBsAg, and/or of the level of HBsAg in the plasma of the subject, is at least 90% (a 1-log reduction) compared to the respective level observed or observable in the plasma of the subject prior to the administering, and the 1-log reduction is maintained for at least 14 days after the administering. In some embodiments, the reduction of the level of HBV DNA in the plasma of the subject is at least 90% (a 1-log reduction). In some embodiments, the reduction of the level of HBV DNA in the plasma of the subject is at least 99% (a 2-log reduction). In some embodiments, the reduction of the level of HBsAg in the plasma of the subject is at least 90% (a 1-log reduction). In some embodiments, the reduction of the level of HBsAg in the plasma of the subject is at least 99% (a 2-log reduction). In some embodiments, the reduction of the level of HBeAg in the plasma of the subject is at least 90% (a 1-log reduction). In some embodiments, the reduction of the level of HBeAg in the plasma of the subject is at least 99% (a 2-log reduction). In some embodiments, the reduction is maintained for at least 21 days. In some embodiments, the reduction is maintained for at least 28 days. In some embodiments, the reduction is maintained for at least 35 days. In some embodiments, the reduction is maintained for at least 42 days. In some embodiments, the reduction is maintained for at least 56 days. In some embodiments, the reduction is maintained for at least 70 days. In some embodiments, the reduction is maintained for at least 84 days. In some embodiments, the reduction is maintained for at least 112 days. In some embodiments, the reduction is maintained for at least 140 days. In some embodiments, the reduction is maintained for at least 168 days. In some embodiments, the reduction is maintained for at least 6 months. In some embodiments, the reduction is maintained for at least 9 months. In some embodiments, the reduction is maintained for at least 12 months. In some embodiments, the reduction is maintained for at least 24 months. In some embodiments, the HBV genome comprises HBV genotype A. In some embodiments, the HBV genome comprises HBV genotype B. In some embodiments, the HBV genome comprises HBV genotype C. In some embodiments, the HBV genome comprises, HBV genotype D. In some embodiments, the HBV genome comprises HBV genotype E. In some embodiments, the HBV genome comprises HBV genotype F. In some embodiments, the HBV genome comprises HBV genotype G. In some embodiments, the HBV genome comprises HBV genotype H. In some embodiments, the HBV genome comprises a sequence with at least 80%, at least 90%, at least 95%, at least 99%, or greater than 99% sequence identity to an HBV genome sequence provided herein. In some embodiments, the first target region is located in a region of the HBV genome within nucleotides 0-303 of an HBV genome provided herein. In some embodiments, the first target region is located within nucleotides 0-303 of SEQ ID NO: 1082. In some embodiments, the first target region is located within nucleotides 0-303 of SEQ ID NO: 1083. In some embodiments, the first target region is located in a region of the HBV genome within nucleotides 1000-2448 of an HBV genome provided herein. In some embodiments, the first target region is located within nucleotides 1000-2448 of SEQ ID NO: 1082. In some embodiments, the first target region is located within nucleotides 1000-2448 of SEQ ID NO: 1083. In some embodiments, the first target region is located in a region of the HBV genome within nucleotides 2802-3182 of an HBV genome provided herein. In some embodiments, the first target region is located within nucleotides 2802-3182 of SEQ ID NO: 1082. In some embodiments, the first target region is located within nucleotides 2802-3182 of SEQ ID NO: 1083. In some embodiments, the first target region of the HBV genome is located in an HBV CpG island (CGI). In some embodiments, the CGI is an HBV canonical CGI. In some embodiments, the CGI is canonical CGI-I. In some embodiments, CGI is canonical CGI-I of HBV genotype D. In some embodiments, CGI-I spans nucleotides 186-288 of SEQ ID NO: 1082In some embodiments, CGI-I spans nucleotides 186-288 of SEQ ID NO: 1083In some embodiments, the CGI is canonical CGI-II. In some embodiments, the CGI is canonical CGI-II HBV genotype D. In some embodiments, the CGI is CGI II spans nucleotides 1,217-1,670 of SEQ ID NO: 1082. In some embodiments, the CGI is CGI II spans nucleotides 1,217-1,670 of SEQ ID NO: 1083. In some embodiments, the CGI is canonical CGI-III. In some embodiments, the CGI is canonical CGI-III HBV genotype D. In some embodiments, the CGI is CGI-III spans nucleotides 2,282-2,448 of SEQ ID NO: 1082. In some embodiments, the CGI is CGI-III spans nucleotides 2,282-2,448 of SEQ ID NO: 1083. In some embodiments, the first target region of the HBV genome is located in a promotor. In some embodiments, the first target region of the HBV genome is located in the sp1 promoter. In some embodiments, the first target region of the HBV genome is located in sp2 promoter. In some embodiments, the first target region of the HBV genome is located in cp promoter. In some embodiments, the first target region of the HBV genome is located in xp promoter. In some embodiments, the first target region of the HBV genome is located in an enhancer region. In some embodiments, the first target region of the HBV genome is located in Enh I. In some embodiments, the first target region of the HBV genome is located in Enh II. In some embodiments, the first target region of the HBV genome is located in a section of the HBV genome that encodes a transcript. In some embodiments, the first target region of the HBV genome is located in a section of the HBV genome that encodes a pgRNA transcript. In some embodiments, the first target region of the HBV genome is located in a section of the HBV genome that encodes a preCore RNA transcript. In some embodiments, the first target region of the HBV genome is located in a section of the HBV genome that encodes a preS RNA transcript. In some embodiments, the first target region of the HBV genome is located in a section of the HBV genome that encodes an S RNA transcript. In some embodiments, the first target region of the HBV genome is located in a section of the HBV genome that encodes an HBx RNA transcript. In some embodiments, the first target region of the HBV genome is within 1000, 900, 800, 700, 600, 500, 400, 300, 200, or 100 base pairs (bp) of an HBV transcription start site (TSS). In some embodiments, the TSS is a pg RNA TSS. In some embodiments, the first target region is within 600, within 500, within 400, within 300, within 200, or within 100 base pairs of the pg RNA TSS. In some embodiments, the pg RNA TSS is located at nucleotide 1820 of SEQ ID NO: 1082 or at nucleotide 1820 of SEQ ID NO: 1083. In some embodiments, the first target region is within 600 base pairs of nucleotide 1820 in SEQ ID NO: 1082. In some embodiments, the first target region is within 600 base pairs of nucleotide 1820 in SEQ ID NO: 1083. In some embodiments, the first target region is within 500 base pairs of nucleotide 1820 in SEQ ID NO: 1082. In some embodiments, the first target region is within 500 base pairs of nucleotide 1820 in SEQ ID NO: 1083. In some embodiments, the first target region is within 400 base pairs of nucleotide 1820 in SEQ ID NO: 1082. In some embodiments, the first target region is within 400 base pairs of nucleotide 1820 in SEQ ID NO: 1083. In some embodiments, the first target region is within 300 base pairs of nucleotide 1820 in SEQ ID NO: 1082. In some embodiments, the first target region is within 300 base pairs of nucleotide 1820 in SEQ ID NO: 1083. In some embodiments, the first target region is within 200 base pairs of nucleotide 1820 in SEQ ID NO: 1082. In some embodiments, the first target region is within 200 base pairs of nucleotide 1820 in SEQ ID NO: 1083. In some embodiments, the first target region is within 100 base pairs of nucleotide 1820 in SEQ ID NO: 1082. In some embodiments, the first target region is within 100 base pairs of nucleotide 1820 in SEQ ID NO: 1083. In some embodiments, the TSS is a preC RNA TSS. In some embodiments, the first target region is within 600, within 500, within 400, within 300, within 200, or within 100 base pairs of the preC RNA TSS. In some embodiments, the preC RNA TSS is located at nucleotide 1791 of SEQ ID NO: 1082 or at nucleotide 1791 of SEQ ID NO: 1083. In some embodiments, the first target region is within 600 base pairs of nucleotide 1791 in SEQ ID NO: 1082. In some embodiments, the first target region is within 600 base pairs of nucleotide 1791 in SEQ ID NO: 1083. In some embodiments, the first target region is within 500 base pairs of nucleotide 1791 in SEQ ID NO: 1082. In some embodiments, the first target region is within 500 base pairs of nucleotide 1791 in SEQ ID NO: 1083. In some embodiments, the first target region is within 400 base pairs of nucleotide 1791 in SEQ ID NO: 1082. In some embodiments, the first target region is within 400 base pairs of nucleotide 1791 in SEQ ID NO: 1083. In some embodiments, the first target region is within 300 base pairs of nucleotide 1791 in SEQ ID NO: 1082. In some embodiments, the first target region is within 300 base pairs of nucleotide 1791 in SEQ ID NO: 1083. In some embodiments, the first target region is within 200 base pairs of nucleotide 1791 in SEQ ID NO: 1082. In some embodiments, the first target region is within 200 base pairs of nucleotide 1791 in SEQ ID NO: 1083. In some embodiments, the first target region is within 100 base pairs of nucleotide 1791 in SEQ ID NO: 1082. In some embodiments, the first target region is within 100 base pairs of nucleotide 1791 in SEQ ID NO: 1083. In some embodiments, the TSS is a preS2 RNA TSS. In some embodiments, the first target region is within 600, within 500, within 400, within 300, within 200, or within 100 base pairs of the preS2 RNA TSS. In some embodiments, the preS2 RNA TSS is located at nucleotide 3159 of SEQ ID NO: 1082 or at nucleotide 3159 of SEQ ID NO: 1083. In some embodiments, the first target region is within 600 base pairs of nucleotide 3159 in SEQ ID NO: 1082. In some embodiments, the first target region is within 600 base pairs of nucleotide 3159 in SEQ ID NO: 1083. In some embodiments, the first target region is within 500 base pairs of nucleotide 3159 in SEQ ID NO: 1082. In some embodiments, the first target region is within 500 base pairs of nucleotide 3159 in SEQ ID NO: 1083. In some embodiments, the first target region is within 400 base pairs of nucleotide 3159 in SEQ ID NO: 1082. In some embodiments, the first target region is within 400 base pairs of nucleotide 3159 in SEQ ID NO: 1083. In some embodiments, the first target region is within 300 base pairs of nucleotide 3159 in SEQ ID NO: 1082. In some embodiments, the first target region is within 300 base pairs of nucleotide 3159 in SEQ ID NO: 1083. In some embodiments, the first target region is within 200 base pairs of nucleotide 3159 in SEQ ID NO: 1082. In some embodiments, the first target region is within 200 base pairs of nucleotide 3159 in SEQ ID NO: 1083. In some embodiments, the first target region is within 100 base pairs of nucleotide 3159 in SEQ ID NO: 1082. In some embodiments, the first target region is within 100 base pairs of nucleotide 3159 in SEQ ID NO: 1083. In some embodiments, the TSS is an HBx RNA TSSs. In some embodiments, the first target region is within 600, within 500, within 400, within 300, within 200, or within 100 base pairs of the HBx RNA TSS. In some embodiments, the HBx RNA TSS is located at a nucleotide within the sequence of nucleotides 1243-1338 of SEQ ID NO: 1082 or nucleotides 1243-1338 of SEQ ID NO: 1083. In some embodiments, the first target region is within 600 base pairs of nucleotide 1243 in SEQ ID NO: 1082. In some embodiments, the first target region is within 600 base pairs of nucleotide 1243 in SEQ ID NO: 1083. In some embodiments, the first target region is within 500 base pairs of nucleotide 1243 in SEQ ID NO:

1082. In some embodiments, the first target region is within 500 base pairs of nucleotide 1243 in SEQ ID NO: 1083. In some embodiments, the first target region is within 400 base pairs of nucleotide 1243 in SEQ ID NO: 1082. In some embodiments, the first target region is within 400 base pairs of nucleotide 1243 in SEQ ID NO: 1083. In some embodiments, the first target region is within 300 base pairs of nucleotide 1243 in SEQ ID NO: 1082. In some embodiments, the first target region is within 300 base pairs of nucleotide 1243 in SEQ ID NO: 1083. In some embodiments, the first target region is within 200 base pairs of nucleotide 1243 in SEQ ID NO: 1082. In some embodiments, the first target region is within 200 base pairs of nucleotide 1243 in SEQ ID NO: 1083. In some embodiments, the first target region is within 100 base pairs of nucleotide 1243 in SEQ ID NO: 1082. In some embodiments, the first target region is within 100 base pairs of nucleotide 1243 in SEQ ID NO: 1083. In some embodiments, the first target region is within 600 base pairs of nucleotide 1338 in SEQ ID NO: 1083. In some embodiments, the first target region is within 500 base pairs of nucleotide 1338 in SEQ ID NO: 1082. In some embodiments, the first target region is within 500 base pairs of nucleotide 1338 in SEQ ID NO: 1083. In some embodiments, first target region is within 400 base pairs of nucleotide 1338 in SEQ ID NO: 1082. In some embodiments, the first target region is within 400 base pairs of nucleotide 1338 in SEQ ID NO: 1083. In some embodiments, the first target region is within 300 base pairs of nucleotide 1338 in SEQ ID NO: 1082. In some embodiments, the first target region is within 300 base pairs of nucleotide 1338 in SEQ ID NO: 1083. In some embodiments, the first target region is within 200 base pairs of nucleotide 1338 in SEQ ID NO: 1082. In some embodiments, the first target region is within 200 base pairs of nucleotide 1338 in SEQ ID NO: 1083. In some embodiments, the first target region is within 100 base pairs of nucleotide 1338 in SEQ ID NO: 1082. In some embodiments, the first target region is within 100 base pairs of nucleotide 1338 in SEQ ID NO: 1083. In some embodiments, the reduction is a reduction in the number of HBV viral episomes. In some embodiments, the reduction is a reduction in the number of cccDNA genomes. In some embodiments, the reduction is a reduction in total HBV DNA. In some embodiments, the reduction is a reduction in the replication of the HBV genome. In some embodiments, the reduction is a reduction in a level of expression of a protein product encoded by the HBV genome. In some embodiments, the reduction is a reduction in a level of HBsAg. In some embodiments, the reduction is a reduction in a level of HBeAg. In some embodiments, the reduction is a reduction of total HBV DNA of at least 70%, at least 80%, at least 90%, at least 95%, at least 99%, or at least 99.9%, and the reduction is maintained for at least 14 days after the contacting or the administering. In some embodiments, the reduction is a reduction of HBeAg of at least 70%, at least 80%, at least 90%, at least 95%, at least 99%, or at least 99.9%, and the reduction is maintained for at least 14 days after the contacting or the administering. In some embodiments, the reduction is a reduction of HBsAg of at least 70%, at least 80%, at least 90%, at least 95%, at least 99%, or at least 99.9%, and the reduction is maintained at or below that level for at least 14 days after the contacting or the administering. In some embodiments, the reduction is a reduction of at least 90%. In some embodiments, the reduction is a reduction of at least 95%. In some embodiments, the reduction is a reduction of at least 99%. In some embodiments, the reduction is a reduction of at least 99.9%. In some embodiments, the reduction is maintained for at least 14 days after the contacting or the administering. In some embodiments, the reduction is maintained for at least 21 days. In some embodiments, the reduction is maintained for at least 28 days. In some embodiments, the reduction is maintained for at least 35 days. In some embodiments, the reduction is maintained for at least 42 days. In some embodiments, the reduction is maintained for at least 56 days. In some embodiments, the reduction is maintained for at least 70 days. In some embodiments, the reduction is maintained for at least 84 days. In some embodiments, the reduction is maintained for at least 112 days. In some embodiments, the reduction is maintained for at least 140 days. In some embodiments, the reduction is maintained for at least 168 days. In some embodiments, the reduction is maintained for at least 6 months. In some embodiments, the reduction is maintained for at least 7 months. In some embodiments, the reduction is maintained for at least 8 months. In some embodiments, the reduction is maintained for at least 9 months. In some embodiments, the reduction is maintained for at least 12 months. In some embodiments, the reduction is maintained for at least 18 months. In some embodiments, the reduction is maintained for at least 24 months. In some embodiments, the epigenetic editing system is administered as a monotherapy. Accordingly, in some embodiments, the method does not comprise administering a nucleoside or nucleotide analog (NUC) to the subject. In some embodiments, the method further comprises administering a NUC to the subject. In some embodiments, the first DNA binding domain comprises a CRISPR-Cas protein. In some embodiments, the epigenetic editing system further comprises a first guide RNA (gRNA) that comprises a region complementary to a strand of the first target region. In some embodiments, the gRNA comprises a sequence selected from a gRNA provided herein, and preferably the gRNA comprises a sequence provided in Table 12 or 13. In some embodiments, the first DNA binding domain comprises a zinc-finger protein. In some embodiments, the zinc-finger protein comprises a zinc-finger motif with a sequence selected from any zinc finger or zinc finger motif provided herein, e.g., in Table 1 or Table 18. In some embodiments, the zinc-finger protein comprises a sequence of any of the zinc finger epigenetic repressors provided herein. In some embodiments, the transcriptional repressor domain comprises ZIM3. In some embodiments, the first DNMT domain is a DNMT3A domain or a DNMT3L domain. In some embodiments, the first DNMT domain comprises a sequence of a DNMT domain provided herein. In some embodiments, the epigenetic editing system comprises the fusion protein provided in SEQ ID NO: 1248 or the fusion protein provided in SEQ ID NO: 1252 and at least one guide RNA provided as gRNA #003, gRNA #007, gRNA #008, gRNA #009, gRNA #011, or gRNA #015 herein. Some aspects of this disclosure provide epigenetic editing systems for use in the methods described herein. In some embodiments, the epigenetic editing system comprises a fusion protein or a nucleic acid encoding the fusion protein, and the fusion protein comprises: (a) a DNA-binding domain that binds a target region of a HBV gene or genome, (b) a first DNA methyltransferase (DNMT) domain, and (c) a transcriptional repressor domain. In some embodiments, the fusion protein comprises a sequence of a fusion protein provided herein. In some embodiments, the DNA-binding domain is a CRISPR-Cas DNA binding domain, and the epigenetic editing system comprises at least gRNA provided herein. In some embodiments, the epigenetic editing system comprises the fusion protein provided in SEQ ID NO: 1248 or the fusion protein provided in SEQ ID NO: 1252 and at least one guide RNA provided as gRNA #003, gRNA #007, gRNA #008, gRNA #009, gRNA #011, or gRNA #015 herein.

Other features, objectives, and advantages of the invention are apparent in the detailed description that follows. It should be understood, however, that the detailed description, while indicating embodiments and embodiments of the invention, is given by way of illustration only, not limitation. Various changes and modifications within the scope of the invention will become apparent to those skilled in the art from the detailed description.

BRIEF DESCRIPTION OF THE DRAWINGS

FIG. 14A is a diagram describing the experimental timeline for a guide RNA assay testing CRISPR-off single construct epigenetic editor in combination with individual exemplary gRNAs in a PXB cell model with ELISA readout for HBe and HBs antigens at day 6; and FIG. 14B is a graph summarizing the percentage reduction in HBV antigens at day 6 relative to non-targeting control.

in FIG. 23C, N=3, EE1=PLA002 and gRNA #007, EE2=PLA002 and gRNA #008, EE3=PLA002 and gRNA #009, EE4=PLA002 and gRNA #015, and EE5=PLA002 and gRNA #011).

FIG. 25C shows the results versus effector only; FIG. 25D shows the results versus no treatment. EE1=PLA002 and gRNA #007, EE2=PLA002 and gRNA #008, EE3=PLA002 and gRNA #009, EE4=PLA002 and gRNA #015, EE5=PLA002 and gRNA #011, EE6=PLA002 and gRNA #003, and EE7=PLA002 and gRNA #016.

DETAILED DESCRIPTION OF THE INVENTION

Figure 1:
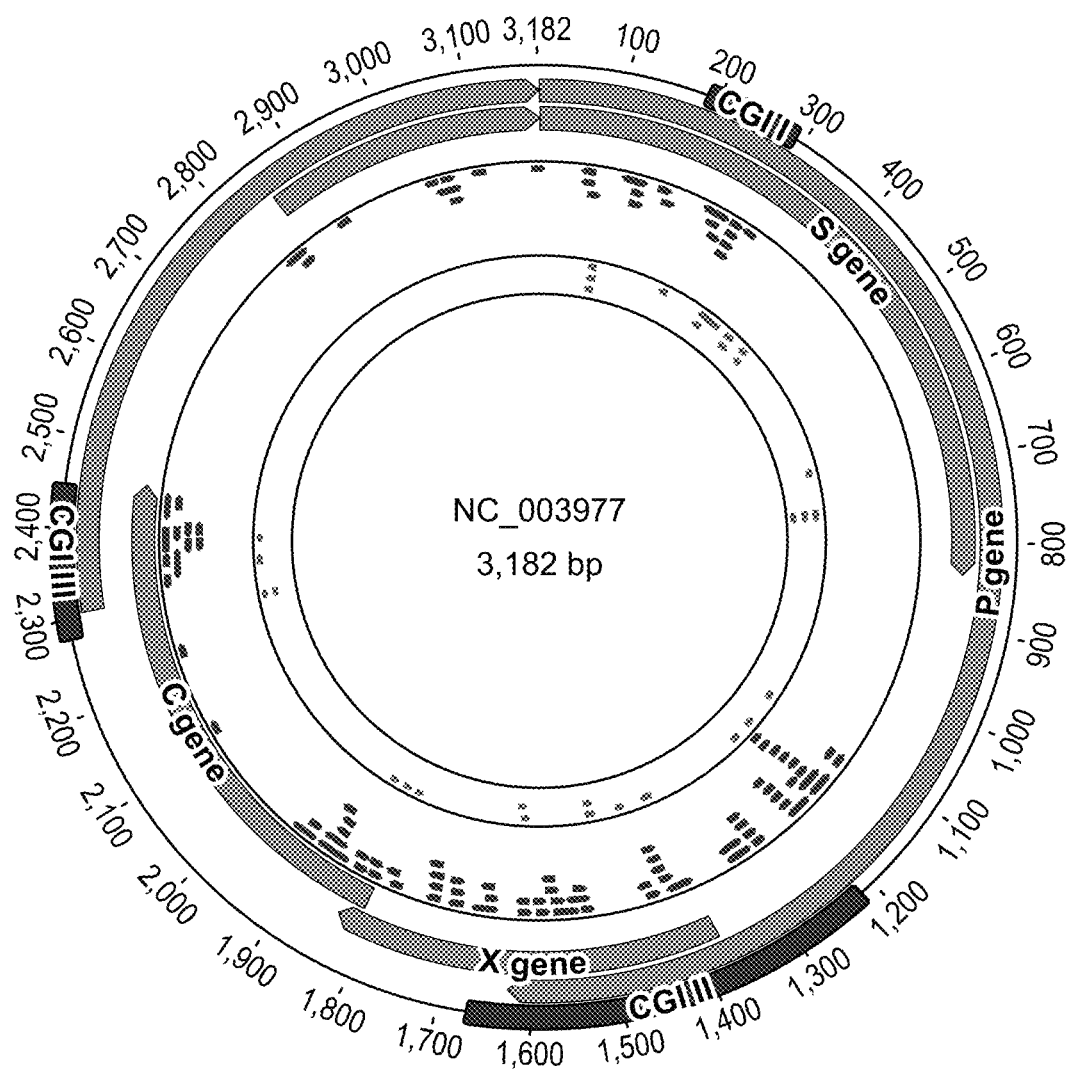
FIG. 1 is a diagram illustrating an exemplary structure of a circular HBV genome. HBV genes and CpG islands are indicated. Exemplary target sites for CRISPR-based epigenetic repressors (red arrows) as well as for zinc-finger-based epigenetic repressors (green arrows) are identified.

The present disclosure provides epigenetic editors, and strategies and methods of using such epigenetic editors, for regulating expression of HBV. By altering expression of HBV, and in particular, by repressing expression of HBV, e.g., of a gene comprised in the HBV genome or a gene product encoded by the HBV genome, the compositions and methods described herein are useful to suppress viral function in infected cells, e.g., in the context of treating an HBV infection in a human subject, or in the context of treating CHB.

The structure and biology of HBV as well as HBV-associated diseases have been reported (see, for example, Yuen, M F., Chen, D S., Dusheiko, G. et al. Hepatitis B virus infection. Nat Rev Dis Primers 4, 18035 (2018), incorporated herein by reference in its entirety).

Exemplary HBV sequences can be found at various NCBI database entries, e.g., representative sequences can be found under accession numbers NC_00397 and U95551, which are incorporated herein by reference in their entirety, and the sequences of which are provided elsewhere herein.

A number of treatment options for HBV has been reported, but there remains a need for effective treatment of HBV infections. Genetic editing approaches targeting HBV genomes for cutting of genomic DNA are associated with a risk of off-target cutting and genomic translocations. The present epigenetic editors and related methods of use have several advantages compared to other genome engineering methods, including increased efficiency, decreased risk of translocation, and durable silencing of HBV.

The present disclosure also provides methods for treating Hepatitis D virus (HDV). HDV is the smallest pathogen known to infect humans. HDV infection is only found in patients infected with HBV, as HDV relies on HBV functions for most of its functions, including viral packaging, infectivity, transmission, and inhibition of host immunity. About 5% of patients with HBV infection also have an HDV infection. HDV uses HBV S-antigen (HBsAg) as a capsid protein, and HDV infection is therefore dependent on HBV S-antigen production. Decreasing HBV S-antigen expression also reduces HDV infectivity. The structure and biology of HDV has been reported (see, for example, Asselah and Rizzetto, Hepatitis D Virus Infection, The New England Journal of Medicine (389; 1; Jul. 6, 2023), incorporated herein by reference in its entirety). In some embodiments of the present disclosure, HDV infection is addressed through methods targeting an HBV gene or genome that reduce the level of HBsAg.

In some embodiments, an epigenetic editor as described herein may comprise one or more fusion proteins, wherein each fusion protein comprises a DNA-binding domain linked to one or more effector domains for epigenetic modification. In certain embodiments, where the DNA-binding domain is a polynucleotide guided DNA-binding domain, the epigenetic editor may further comprise one or more guide polynucleotides. DNA-binding domains, effector domains, and guide polynucleotides of an epigenetic editor as described herein may be selected, e.g., from those described below, in any functional combination.

The epigenetic editors described herein may be expressed in a host cell transiently, or may be integrated in a genome of the host cell; such cells and their progeny are also contemplated by the present disclosure. Both transiently expressed and integrated epigenetic editors or components thereof can effect stable epigenetic modifications. For example, after introducing to a host cell an epigenetic editor described herein, the target gene in the host cell may be stably or permanently repressed or silenced. For example, in some embodiments provided herein, a transiently expressed epigenetic editor comprising a DNMT3A domain, a DNMT3L domain, and a KRAB domain effects stable epigenetic modifications. For example, in some embodiments provided herein, a constitutively expressed epigenetic editor comprising DNMT3A and a DNMT3L domain effects stable epigenetic modifications. In some embodiments, expression of the target gene is reduced or silenced for at least 1 week, at least 2 weeks, at least 3 weeks, at least 4 weeks, at least 5 weeks, at least 6 weeks, at least 7 weeks, at least 2 months, at least 3 months, at least 4 months, at least 5 months, at least 6 months, at least 1 year, at least 2 years, or for the entire lifetime of the cell or the subject carrying the cell, as compared to the level of expression in the absence of the epigenetic editor. The epigenetic modification may be inherited by the progeny of the host cells into which the epigenetic editor was introduced. In some embodiments, the host cell is a liver cell characterized by the presence of an HBV genome in the cell.

The present epigenetic editors may be introduced to a patient in need thereof (e.g., a human patient), e.g., into the patient's hepatocytes, biliary epithelial cells (cholangiocytes), stellate cells, Kupffer cells, and liver sinusoidal endothelial cells.

I. DNA-Binding Domains

An epigenetic editor described herein may comprise one or more DNA-binding domains that direct the effector domain(s) of the epigenetic editor to target sequences within an HBV genome. A DNA-binding domain as described herein may be, e.g., a polynucleotide guided DNA-binding domain, a zinc finger protein (ZFP) domain, a transcription activator like effector (TALE) domain, a meganuclease DNA-binding domain, and the like. Examples of DNA-binding domains can be found in U.S. Pat. No. 11,162,114, which is incorporated by reference herein in its entirety.

In some embodiments, a DNA-binding domain described herein is encoded by its native coding sequence. In other embodiments, the DNA-binding domain is encoded by a nucleotide sequence that has been codon-optimized for optimal expression in human cells.

A. Polynucleotide Guided DNA-Binding Domains

In some embodiments, a DNA-binding domain herein may be a protein domain directed by a guide nucleic acid sequence (e.g., a guide RNA sequence) to a target site in an HBV genome. In certain embodiments, the protein domain may be derived from a CRISPR-associated nuclease, such as a Class I or II CRISPR-associated nuclease. In some embodiments, the protein domain may be derived from a Cas nuclease such as a Type II, Type IIA, Type IIB, Type IIC, Type V, or Type VI Cas nuclease. In certain embodiments, the protein domain may be derived from a Class II Cas nuclease selected from Cas1, Cas1B, Cas2, Cas3, Cas4, Cas5, Cas6, Cas7, Cas8, Cas9, Cas10, Cas14a, Cas14b, Cas14c, CasX, CasY, CasPhi, C2c4, C2c8, C2c9, C2c10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, and homologues and modified versions thereof. "Derived from" is used to mean that the protein domain comprises the full polypeptide sequence of the parent protein, or comprises a variant thereof (e.g., with amino acid residue deletions, insertions, and/or substitutions). The variant retains the desired function of the parent protein (e.g., the ability to form a complex with the guide nucleic acid sequence and the target DNA).

In some embodiments, the CRISPR-associated protein domain may be a Cas9 domain described herein. Cas9 may, for example, refer to a polypeptide with at least about 85%, 90%, 91%, 92%, 93%, 94%, 95%, 96%, 97%, 98%, 99%, or 100% sequence identity and/or sequence similarity to a wildtype Cas9 polypeptide described herein. In some embodiments, said wildtype polypeptide is Cas9 from *Streptococcus pyogenes* (NCBI Ref. No. NC_002737.2 (SEQ ID NO: 1)) and/or UniProt Ref. No. Q99ZW2 (SEQ ID NO: 2). In some embodiments, said wildtype polypeptide is Cas9 from *Staphylococcus aureus* (SEQ ID NO: 3). In some embodiments, the CRISPR-associated protein domain is a Cpf1 domain or protein, or a polypeptide with at least about 85%, 90%, 91%, 92%, 93%, 94%, 95%, 96%, 97%, 98%, 99%, or 100% sequence identity and/or sequence similarity to a wildtype Cpf1 polypeptide described herein (e.g., Cpf1 from *Franscisella novicida* (UniProt Ref. No. U2UMQ6 or SEQ ID NO: 4). In certain embodiments, the CRISPR-associated protein domain may be a modified form of the wildtype protein comprising one or more amino acid residue changes such as a deletion, an insertion, or a substitution; a fusion or chimera; or any combination thereof.

Cas9 sequences and structures of variant Cas9 orthologs have been described for various organisms. Exemplary organisms from which a Cas9 domain herein can be derived include, but are not limited to, *Streptococcus pyogenes, Streptococcus thermophilus, Streptococcus sp., Staphylococcus aureus, Listeria innocua, Lactobacillus gasseri, Francisella novicida, Wolinella succinogenes, Sutterella wadsworthensis, Gamma proteobacterium, Neisseria meningitidis, Campylobacter jejuni, Pasteurella multocida, Fibrobacter succinogene, Rhodospirillum rubrum, Nocardiopsis dassonvillei, Streptomyces pristinaespiralis, Streptomyces viridochromogenes, Streptomyces viridochromogenes, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Lactobacillus buchneri, Treponema denticola, Microscilla marina, Burkholderiales bacterium, Polar omonas naphthalenivorans, Polar omonas sp., Crocosphaera watsonii, Cyanothece sp., Microcystis aeruginosa, Synechococcus sp., Acetohalobium arabaticum, Ammonifex degensii, Caldicelulosiruptor becscii, Candidatus Desulforudis, Clostridium botulinum, Clostridium difficile, Finegoldia magna, Natranaerobius thermophilus, Pelotomaculum thermopropionium, Acidithiobacillus caldus, Acidithiobacillus ferrooxidans, Allochromatium vinosum, Marinobacter sp., Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc sp., Arthrospira maxima, Arthrospira platensis, Arthrospira sp., Lyngbya sp., Microcoleus chthonoplastes, Oscillator ia sp., Petrotoga mobilis, Thermosipho africanus, Streptococcus pasteurianus, Neisseria cinerea, Campylobacter lari, Parvibaculum lavamentivorans, Coryne bacterium diphtheria*, and *Acaryochloris marina*. Cas9 sequences also include those from the organisms and loci disclosed in Chylinski et al., RNA Biol. (2013) 10(5):726-37.

In some embodiments, the Cas9 domain is from *Streptococcus pyogenes*. In some embodiments, the Cas9 domain is from *Staphylococcus aureus*.

Other Cas domains are also contemplated for use in the epigenetic editors herein. These include, for example, those from CasX (Cas12E) (e.g., SEQ ID NO: 5), CasY (Cas12d) (e.g., SEQ ID NO: 6), Casφ (CasPhi) (e.g., SEQ ID NO: 7), Cas12f1 (Cas14a) (e.g., SEQ ID NO: 8), Cas12f2 (Cas14b) (e.g., SEQ ID NO: 9), Cas12f3 (Cas14c) (e.g., SEQ ID NO: 10), and C2c8 (e.g., SEQ ID NO: 11).

For epigenetic editing, the nuclease-derived protein domain (e.g., a Cas9 or Cpf1 domain) may have reduced or no nuclease activity through mutations such that the protein domain does not cleave DNA or has reduced DNA-cleaving activity while retaining the ability to complex with the guide nucleic acid sequence (e.g., guide RNA) and the target DNA. For example, the nuclease activity may be reduced by at least 30%, 35%, 40%, 45%, 50%, 55%, 60%, 65%, 70%, 75%, 80%, 85%, 90%, 95%, or 99% compared to the wildtype domain. In some embodiments, a CRISPR-associated protein domain described herein is catalytically inactive ("dead"). Examples of such domains include, for example, dCas9 ("dead" Cas9), dCpf1, ddCpf1, dCasPhi, ddCas12a, dLbCpf1, and dFnCpf1. A dCas9 protein domain, for example, may comprise one, two, or more mutations as compared to wildtype Cas9 that abrogate its nuclease activity. The DNA cleavage domain of Cas9 is known to include two subdomains: the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A (in RuvC1) and H840A (in HNH) completely inactivate the nuclease activity of SpCas9. SaCas9, similarly, may be inactivated by the mutations D10A and N580A. In some embodiments, the dCas9 comprises at least one mutation in the HNH subdomain and/or the RuvC1 subdomain that reduces or abrogates nuclease activity. In some embodiments, the dCas9 only comprises a RuvC1 subdomain, or only comprises an HNH subdomain. It is to be understood that any mutation that inactivates the RuvC1 and/or the HNH domain may be included in a dCas9 herein, e.g., insertion, deletion, or single or multiple amino acid substitution in the RuvC1 domain and/or the HNH domain.

In some embodiments, a dCas9 protein herein comprises a mutation at position(s) corresponding to position D10 (e.g., D10A), H840 (e.g., H840A), or both, of a wildtype SpCas9 sequence as numbered in the sequence provided at UniProt Accession No. Q99ZW2 (SEQ ID NO: 2). In particular embodiments, the dCas9 comprises the amino acid sequence of dSpCas9 (D10A and H840A) (SEQ ID NO: 12).

In some embodiments, a dCas9 protein as described herein comprises a mutation at position(s) corresponding to position D10 (e.g., D10A), N580 (e.g., N580A), or both, of a wildtype SaCas9 sequence (e.g., SEQ ID NO: 9). In particular embodiments, the dCas9 comprises the amino acid sequence of dSaCas9 (D10A and N580A) (SEQ ID NO: 13).

Additional suitable mutations that inactivate Cas9 will be apparent to those of skill in the art based on this disclosure and knowledge in the field and are within the scope of this disclosure. Such mutations may include, but are not limited to, D839A, N863A, and/or K603R in SpCas9. The present disclosure contemplates any mutations that reduce or abrogate the nuclease activity of any Cas9 described herein (e.g., mutations corresponding to any of the Cas9 mutations described herein).

A dCpf1 protein domain may comprise one, two, or more mutations as compared to wildtype Cpf1 that reduce or abrogate its nuclease activity. The Cpf1 protein has a RuvC-like endonuclease domain that is similar to the RuvC domain of Cas9, but does not have an HNH endonuclease domain, and the N-terminal of Cpf1 does not have the alpha-helical recognition lobe of Cas9. In some embodiments, the dCpf1 comprises one or more mutations corresponding to position D917A, E1006A, or D1255A as numbered in the sequence of the *Francisella novicida* Cpf1 protein (FnCpf1; SEQ ID NO: 4). In certain embodiments, the dCpf1 protein comprises mutations corresponding to D917A, E1006A, D1255A, D917A/E1006A, D917A/D1255A, E1006A/D1255A, or D917A/E1006A/D1255A, or corresponding mutation(s) in any of the Cpf1 amino acid sequences described herein. In some embodiments, the dCpf1 comprises a D917A mutation. In particular embodiments, the dCpf1 comprises the amino acid sequence of dFnCpf1 (SEQ ID NO: 14).

Further nuclease inactive CRISPR-associated protein domains contemplated herein include those from, for example, dNmeCas9 (e.g., SEQ ID NO: 15), dCjCas9 (e.g., SEQ ID NO: 16), dSt1Cas9 (e.g., SEQ ID NO: 17), dSt3Cas9 (e.g., SEQ ID NO: 18), dLbCpf1 (e.g., SEQ ID NO: 19), dAsCpf1 (e.g., SEQ ID NO: 20), denAsCpf1 (e.g., SEQ ID NO: 21), dHFAsCpf1 (e.g., SEQ ID NO: 22), dRVRAsCpf1 (e.g., SEQ ID NO: 23), dRRAsCpf1 (e.g., SEQ ID NO: 24), dCasX (e.g., SEQ ID NO: 25), and dCasPhi (e.g., SEQ ID NO: 26).

In some embodiments, a Cas9 domain described herein may be a high fidelity Cas9 domain, e.g., comprising one or more mutations that decrease electrostatic interactions between the Cas9 domain and the sugar-phosphate backbone of DNA to confer increased target binding specificity. In certain embodiments, the high fidelity Cas9 domain may be nuclease inactive as described herein.

A CRISPR-associated protein domain described herein may recognize a protospacer adjacent motif (PAM) sequence in a target gene. A "PAM" sequence is typically a 2 to 6 bp DNA sequence immediately following the sequence targeted by the CRISPR-associated protein domain. The PAM sequence is required for CRISPR protein binding and cleavage but is not part of the target sequence. The CRISPR-associated protein domain may either recognize a naturally occurring or canonical PAM sequence or may have altered PAM specificity. CRISPR-associated protein domains that bind to non-canonical PAM sequences have been described in the art. For example, Cas9 domains that bind non-canonical PAM sequences have been described in Kleinstiver et al., Nature (2015) 523(7561):481-5 and Kleinstiver et al., *Nat Biotechnol.* (2015) 33:1293-8. Such Cas9 domains may include, for example, those from "VRER (SEQ ID NO: 1261)" SpCas9, "EQR" SpCas9, "VQR" SpCas9, "SpG Cas9," "SpRYCas9," and "KKH" SaCas9. Nuclease inactive versions of these Cas9 domains are also contemplated, such as nuclease inactive VRER (SEQ ID NO: 1261) SpCas9 (e.g., SEQ ID NO: 27), nuclease inactive EQR SpCas9 (e.g., SEQ ID NO: 28), nuclease inactive VQR SpCas9 (e.g., SEQ ID NO: 29), nuclease inactive SpG Cas9 (e.g., SEQ ID NO: 30), nuclease inactive SpRY Cas9 (e.g., SEQ ID NO: 31), and nuclease inactive KKH SaCas9 (e.g., SEQ ID NO: 32). Another example is the Cas9 of *Francisella novicida* engineered to recognize 5'-YG-3' (where "Y" is a pyrimidine).

Additional suitable CRISPR-associated proteins, orthologs, and variants, including nuclease inactive variants and sequences, will be apparent to those of skill in the art based on this disclosure.

Guide RNAs that can be used in conjunction with the CRISPR-associated protein domains herein are further described in Section II below.

B. Zinc Finger Protein Domains

In some embodiments, the DNA-binding domain of an epigenetic editor described herein comprises a zinc finger protein (ZFP) domain (or "ZF domain" as used herein). ZFPs are proteins having at least one zinc finger, and bind to DNA in a sequence-specific manner. A "zinc finger" (ZF) or "zinc finger motif" (ZF motif) refers to a polypeptide domain comprising a beta-beta-alpha (ββα)-protein fold stabilized by a zinc ion. A ZF binds from two to four base pairs of nucleotides, typically three or four base pairs (contiguous or noncontiguous). Each ZF typically comprises approximately 30 amino acids. ZFP domains may contain multiple ZFs that make tandem contacts with their target nucleic acid sequence. A tandem array of ZFs may be engineered to generate artificial ZFPs that bind desired nucleic acid targets. ZFPs may be rationally designed by using databases comprising triplet (or quadruplet) nucleotide sequences and individual ZF amino acid sequences, in which each triplet or quadruplet nucleotide sequence is associated with one or more amino acid sequences of ZFs that bind the particular triplet or quadruplet sequence. See, e.g., U.S. Pat. Nos. 6,453,242, 6,534,261, and 8,772,453.

ZFPs are widespread in eukaryotic cells, and may belong to, e.g., C2H2 class, CCHC class, PHD class, or RING class. An exemplary motif characterizing one class of these proteins (C2H2 class) is -Cys-(X)$_{2-4}$-Cys-(X)$_{12}$-His-(X)$_{3-5}$-His- (SEQ ID NO:1091), where X is any independently chosen amino acid. In some embodiments, a ZFP domain herein may comprise a ZF array comprising sequential C2H2-ZFs each contacting three or more sequential nucleotides. Additional architectures, e.g. as described in Paschon et al., Nat. Commun. 10, 1133 (2019), are also possible.

A ZFP domain of an epigenetic editor described herein may include 2, 3, 4, 5, 6, 7, 8, 9, 10, 11, 12, or more ZFs. The ZFP domain may include an array of two-finger or three-finger units, e.g., 3, 4, 5, 6, 7, 8, 9 or 10 or more units, wherein each unit binds a subsite in the target sequence. In some embodiments, a ZFP domain comprising at least three ZFs recognizes a target DNA sequence of 9 or 10 nucleotides. In some embodiments, a ZFP domain comprising at least four ZFs recognizes a target DNA sequence of 12 to 14 nucleotides. In some embodiments, a ZFP domain comprising at least six ZFs recognizes a target DNA sequence of 18 to 21 nucleotides.

In some embodiments, ZFs in a ZFP domain described herein are connected via peptide linkers. The peptide linkers may be, e.g., 2, 3, 4, 5, 6, 7, 8, 9, 10, 11, 12, 13, 14, 15, 16, 17, 18, 19, 20, or more amino acids in length. In some embodiments, a linker comprises 5 or more amino acids. In some embodiments, a linker comprises 7-17 amino acids. The linker may be flexible or rigid.

In some embodiments a zinc finger array may have the sequence:

```
SRPGERPFQCRICMRNFSXXXXXXXHXXTHTGEKPFQCRICMRNF

SXXXXXXXHXXTH[linker]FQCRICMRNFSXXXXXXXHXXTHT

GEKPFQCRICMRNFSXXXXXXXHXXTH[linker]PFQCRICMRN

FSXXXXXXXHXXTHTGEKPFQCRICMRNFSXXXXXXXHXXTHLRG

S
(SEQ ID NOs: 1084 and 1258-1259, respectively,
in order of appearance),
``` or a sequence at least 70%, 75%, 80%, 85%, 90%, 95%, 96%, 97%, 98%, or 99% identical thereto, where "XXXXXXX" represents the amino acids of the ZF recognition helix, which confers DNA-binding specificity upon the zinc finger; each X may be independently chosen. In the above sequence, "XX" in italics may be TR, LR or LK, and "[linker]" represents a linker sequence. In some embodiments, the linker sequence is TGSQKP (SEQ ID NO: 1085); this linker may be used when sub-sites targeted by the ZFs are adjacent. In some embodiments, the linker sequence is TGGGGSQKP (SEQ ID NO: 1086); this linker may be used when there is a base between the sub-sites targeted by the zinc fingers. The two indicated linkers may be the same or different.

ZFP domains herein may contain arrays of two or more adjacent ZFs that are directly adjacent to one another (e.g., separated by a short (canonical) linker sequence), or are separated by longer, flexible or structured polypeptide sequences. In some embodiments, directly adjacent fingers bind to contiguous nucleic acid sequences, i.e., to adjacent trinucleotides/triplets. In some embodiments, adjacent fingers cross-bind between each other's respective target triplets, which may help to strengthen or enhance the recognition of the target sequence, and leads to the binding of overlapping sequences. In some embodiments, distant ZFs within the ZFP domain may recognize (or bind to) non-contiguous nucleotide sequences.

The amino acid sequences of the ZF DNA-recognition helices of exemplary ZFP domains herein, and their HBV target sequences, are shown below in Table 1. Table 1. Zinc finger transcriptional repressors for silencing HBV.

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| ZFP902 | 39 | GGATTCAGCG CCGACGGG (SEQ ID NO: 104) | 1433 | 1450 | - | RQEH LVR (SEQ ID NO: 129) | EGGN LMR (SEQ ID NO: 160) | SDRR DLD (SEQ ID NO: 192) | SFQS YLE (SEQ ID NO: 224) | RPNH LAI (SEQ ID NO: 260) | QSPH LKR (SEQ ID NO: 300) |
| ZFP903 | 40 | GGATTCAGCG CCGACGGG (SEQ ID NO: 104) | 1433 | 1450 | - | RREH LVR (SEQ ID NO: 130) | DPSN LQR (SEQ ID NO: 161) | SDRR DLD (SEQ ID NO: 192) | SFQS YLE (SEQ ID NO: 224) | RPNH LAI (SEQ ID NO: 260) | QSPH LKR (SEQ ID NO: 300) |
| ZFP904 | 41 | GGATTCAGCG CCGACGGG (SEQ ID NO: 104) | 1433 | 1450 | - | RREH LVR (SEQ ID NO: 130) | DMGN LGR (SEQ ID NO: 162) | SDRR DLD (SEQ ID NO: 192) | SFQS YLE (SEQ ID NO: 224) | RPNH LAI (SEQ ID NO: 260) | QSPH LKR (SEQ ID NO: 300) |
| ZFP907 | 42 | GGCAGTAGTC GGAACAGGG (SEQ ID NO: 105) | 90 | 108 | - | KKDH LHR (SEQ ID NO: 131) | QKEI LTR (SEQ ID NO: 163) | QSAH LKR (SEQ ID NO: 193) | ETGS LRR (SEQ ID NO: 225) | QSHS LKS (SEQ ID NO: 261) | ESGH LKR (SEQ ID NO: 301) |
| ZFP908 | 43 | GGCAGTAGTC GGAACAGGG (SEQ ID NO: 105) | 90 | 108 | - | KKDH LHR (SEQ ID NO: 131) | QKEI LTR (SEQ ID NO: 163) | QSAH LKR (SEQ ID NO: 193) | DRTP LNR (SEQ ID NO: 226) | QSHS LKS (SEQ ID NO: 261) | ESGH LKR (SEQ ID NO: 301) |
| ZFP909 | 44 | GGCAGTAGTC GGAACAGGG | 90 | 108 | - | KTDH LAR (SEQ ID NO: 132) | QKEI LTR (SEQ ID NO: 163) | QSAH LKR (SEQ ID NO: 193) | ETGS LRR (SEQ ID NO: 225) | QKHH LVT (SEQ ID NO: 262) | ENSK LRR (SEQ ID NO: 302) |
| ZFP912 | 45 | GTAAACTGAG CCAGGAGAA (SEQ ID NO: 106) | 664 | 682 | - | QAGN LVR (SEQ ID NO: 133) | QNSH LRR (SEQ ID NO: 164) | DLST LRR (SEQ ID NO: 194) | QNEH LKV (SEQ ID NO: 227) | GGTA LRM (SEQ ID NO: 263) | QRSS LVR (SEQ ID NO: 303) |
| ZFP913 | 46 | GTAAACTGAG CCAGGAGAA (SEQ ID NO: 106) | 664 | 682 | - | QRGN LQR (SEQ ID NO: 134) | QTTH LSR (SEQ ID NO: 165) | DGST LRR (SEQ ID NO: 195) | QKTH LAV (SEQ ID NO: 228) | GGTA LRM (SEQ ID NO: 263) | QRSS LVR (SEQ ID NO: 303) |
| ZFP914 | 47 | GTAAACTGAG CCAGGAGAA (SEQ ID NO: 106) | 664 | 682 | - | QRGN LQR (SEQ ID NO: 134) | QTTH LSR (SEQ ID NO: 165) | DLST LRR (SEQ ID NO: 194) | QNEH LKV (SEQ ID NO: 227) | GGSA LSM (SEQ ID NO: 264) | QRSS LVR (SEQ ID NO: 303) |
| ZFP930 | 48 | ACGGTGGTCT CCATGCGAC (SEQ ID NO: 107) | 1605 | 1623 | - | DRGN LTR (SEQ ID NO: 135) | QARS LRA (SEQ ID NO: 166) | EKAS LIK (SEQ ID NO: 196) | DHSS LKR (SEQ ID NO: 229) | RRFI LSR (SEQ ID NO: 265) | RNDS LKC (SEQ ID NO: 304) |
| ZFP931 | 49 | ACGGTGGTCT CCATGCGAC (SEQ ID NO: 107) | 1605 | 1623 | - | DRGN LTR (SEQ ID | QARS LRA (SEQ ID | DKSS LRK (SEQ ID | DHSS LKR (SEQ ID | RNFI LQR (SEQ ID | RNDT LII (SEQ ID |

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| | | | | | | NO: 135) | NO: 166) | NO: 197) | NO: 229) | NO: 266) | NO: 305) |
| ZFP932 | 50 | ACGGTGGTCT CCATGCGAC (SEQ ID NO: 107) | 1605 | 1623 | − | DRGN LTR (SEQ ID NO: 135) | QARS LRA (SEQ ID NO: 166) | CNGS LKK (SEQ ID NO: 198) | DHSS LKR (SEQ ID NO: 229) | RNFI LQR (SEQ ID NO: 266) | RNDT LII (SEQ ID NO: 305) |
| ZFP933 | 51 | GCTGGATGTG TCTGCGGCG (SEQ ID NO: 108) | 372 | 393 | + | RTDT LAR (SEQ ID NO: 136) | RTDS LPR (SEQ ID NO: 167) | DHSS LAH (SEQ ID NO: 199) | QPHG LKR (SEQ ID NO: 230) | QSAH LKR (SEQ ID NO: 267) | VGNS LSR (SEQ ID NO: 306) |
| ZFP934 | 52 | GCTGGATGTG TCTGCGGCG (SEQ ID NO: 108) | 372 | 393 | + | RTDT LAR (SEQ ID NO: 136) | RTDS LPR (SEQ ID NO: 167) | DHSS LKR (SEQ ID NO: 199) | QPHG LRH (SEQ ID NO: 231) | QSAH LKR (SEQ ID NO: 267) | VGNS LSR (SEQ ID NO: 306) |
| ZFP935 | 53 | GCTGGATGTG TCTGCGGCG (SEQ ID NO: 108) | 372 | 393 | + | RTDT LAR (SEQ ID NO: 136) | RLDM LAR (SEQ ID NO: 168) | DHSS LKR (SEQ ID NO: 199) | QPHG LST (SEQ ID NO: 232) | QQAH LVR (SEQ ID NO: 268) | VHES LKR (SEQ ID NO: 307) |
| ZFP938 | 54 | GTCTGCGAGG CGAGGGAG (SEQ ID NO: 109) | 2381 | 2398 | − | RADN LGR (SEQ ID NO: 137) | RNTH LSY (SEQ ID NO: 169) | RGDG LRR (SEQ ID NO: 200) | RRDN LNR (SEQ ID NO: 233) | RARN LTL (SEQ ID NO: 269) | DPSS LKR (SEQ ID NO: 308) |
| ZFP939 | 55 | GTCTGCGAGG CGAGGGAG (SEQ ID NO: 109) | 2381 | 2398 | − | RADN LGR (SEQ ID NO: 137) | RNTH LSY (SEQ ID NO: 169) | RKLG LLR (SEQ ID NO: 201) | RQDN LGR (SEQ ID NO: 234) | RARN LTL (SEQ ID NO: 269) | DPSS LKR (SEQ ID NO: 308) |
| ZFP940 | 56 | GTCTGCGAGG CGAGGGAG (SEQ ID NO: 109) | 2381 | 2398 | − | RADN LGR (SEQ ID NO: 137) | RNTH LSY (SEQ ID NO: 169) | RKLG LLR (SEQ ID NO: 201) | RODN LGR (SEQ ID NO: 234) | RRRN LQL (SEQ ID NO: 270) | DHSS LKR (SEQ ID NO: 309) |
| ZFP943 | 57 | GTTGCCGGGC AACGGGGTA (SEQ ID NO: 110) | 1146 | 1164 | − | QQSS LLR (SEQ ID NO: 138) | RREH LVR (SEQ ID NO: 170) | GLTA LRT (SEQ ID NO: 202) | ERAK LIR (SEQ ID NO: 235) | AKRD LDR (SEQ ID NO: 271) | VNSS LTR (SEQ ID NO: 310) |
| ZFP944 | 58 | GTTGCCGGGC AACGGGGTA (SEQ ID NO: 110) | 1146 | 1164 | − | QQSS LLR (SEQ ID NO: 138) | RREH LVR (SEQ ID NO: 170) | GLTA LRT (SEQ ID NO: 202) | ERAK LIR (SEQ ID NO: 235) | LRKD LVR (SEQ ID NO: 272) | VRHS LTR (SEQ ID NO: 311) |
| ZFP945 | 59 | GTTGCCGGGC AACGGGGTA (SEQ ID NO: 110) | 1146 | 1164 | − | QASA LSR (SEQ ID NO: 139) | RREH LVR (SEQ ID NO: 170) | GLTA LRT (SEQ ID NO: 202) | ERAK LIR (SEQ ID NO: 235) | AKRD LDR (SEQ ID NO: 271) | VNSS LTR (SEQ ID NO: 310) |
| ZFP951 | 60 | CGAGAAAGTG AAAGCCTGC | 1085 | 1103 | − | RGRN LEM | DSSV LRR | QNAN LKR | QKHH LAV | QRSN LAR | QKVH LEA |

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| | | (SEQ ID NO: 111) | | | | (SEQ ID NO: 140) | (SEQ ID NO: 171) | (SEQ ID NO: 203) | (SEQ ID NO: 236) | (SEQ ID NO: 273) | (SEQ ID NO: 312) |
| ZFP952 | 61 | CGAGAAAGTG AAAGCCTGC (SEQ ID NO: 111) | 1085 | 1103 | − | RRRN LDV (SEQ ID NO: 141) | DSSV LRR (SEQ ID NO: 171) | QNAN LKR (SEQ ID NO: 203) | QKHH LAV (SEQ ID NO: 236) | QRSN LAR (SEQ ID NO: 273) | QKVH LEA (SEQ ID NO: 312) |
| ZFP953 | 62 | CGAGAAAGTG AAAGCCTGC (SEQ ID NO: 111) | 1085 | 1103 | − | RGRN LAI (SEQ ID NO: 142) | DSSV LRR (SEQ ID NO: 171) | LKSN LHR (SEQ ID NO: 204) | LKQH LVV (SEQ ID NO: 237) | LKTN LAR (SEQ ID NO: 274) | QKCH LKA (SEQ ID NO: 313) |
| ZFP956 | 63 | GAGGCTTGAA CAGTAGGAC (SEQ ID NO: 112) | 1856 | 1874 | − | DGSN LRR (SEQ ID NO: 143) | RIDN LDG (SEQ ID NO: 172) | QRRY LVE (SEQ ID NO: 205) | QQTN LAR (SEQ ID NO: 238) | QRSD LTR (SEQ ID NO: 275) | RGDN LNR (SEQ ID NO: 314) |
| ZFP957 | 64 | GAGGCTTGAA CAGTAGGAC (SEQ ID NO: 112) | 1856 | 1874 | − | DPSN LQR (SEQ ID NO: 144) | RRDN LPK (SEQ ID NO: 173) | TTFN LRV (SEQ ID NO: 206) | QTQN LTR (SEQ ID NO: 239) | HKET LNR (SEQ ID NO: 276) | REDN LGR (SEQ ID NO: 315) |
| ZFP958 | 65 | GAGGCTTGAA CAGTAGGAC (SEQ ID NO: 112) | 1856 | 1874 | − | DPSN LQR (SEQ ID NO: 144) | RRDN LPK (SEQ ID NO: 173) | QRRY LVE (SEQ ID NO: 205) | QQTN LAR (SEQ ID NO: 238) | QRSD LTR (SEQ ID NO: 275) | RGDN LNR (SEQ ID NO: 314) |
| ZFP961 | 66 | GAGGTTGGGG ACTGCGAA (SEQ ID NO: 113) | 312 | 329 | − | QQTN LTR (SEQ ID NO: 145) | ANRT LVH (SEQ ID NO: 174) | EEAN LRR (SEQ ID NO: 207) | RGEH LTR (SEQ ID NO: 240) | TNSS LTR (SEQ ID NO: 277) | RIDN LIR (SEQ ID NO: 316) |
| ZFP962 | 67 | GAGGTTGGGG ACTGCGAA (SEQ ID NO: 113) | 312 | 329 | − | QQTN LTR (SEQ ID NO: 145) | ANRT LVH (SEQ ID NO: 174) | EEAN LRR (SEQ ID NO: 207) | RREH LVR (SEQ ID NO: 241) | MTSS LRR (SEQ ID NO: 278) | RQDN LGR (SEQ ID NO: 317) |
| ZFP963 | 68 | GAGGTTGGGG ACTGCGAA (SEQ ID NO: 113) | 312 | 329 | − | QQTN LTR (SEQ ID NO: 145) | ANRT LVH (SEQ ID NO: 174) | EEAN LRR (SEQ ID NO: 207) | RGEH LTR (SEQ ID NO: 240) | MTSS LRR (SEQ ID NO: 278) | RQDN LGR (SEQ ID NO: 317) |
| ZFP964 | 69 | GATGATGTGG TATTGGGG (SEQ ID NO: 114) | 742 | 762 | + | RATH LTR (SEQ ID NO: 146) | RADV LKG (SEQ ID NO: 175) | QRSS LVR (SEQ ID NO: 208) | RKDA LHV (SEQ ID NO: 242) | VHHN LVR (SEQ ID NO: 259) | ISHN LAR (SEQ ID NO: 299) |
| ZFP965 | 70 | GATGATGTGG TATTGGGG (SEQ ID NO: 114) | 742 | 762 | + | RATH LTR (SEQ ID NO: 146) | RADV LKG (SEQ ID NO: 175) | QSSS LVR (SEQ ID NO: 209) | RKER LAT (SEQ ID NO: 243) | VRHN LTR (SEQ ID NO: 279) | ISHN LAR (SEQ ID NO: 299) |

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| ZFP966 | 71 | GATGATGTGG TATTGGGG (SEQ ID NO: 114) | 742 | 762 | + | KKDH LHR (SEQ ID NO: 131) | RKES LTV (SEQ ID NO: 176) | QSSS LVR (SEQ ID NO: 209) | RKER LAT (SEQ ID NO: 243) | VHHN LVR (SEQ ID NO: 259) | ISHN LAR (SEQ ID NO: 299) |
| ZFP969 | 72 | GATGATGTGG TATTGGGGG (SEQ ID NO: 115) | 742 | 763 | + | RVDH LHR (SEQ ID NO: 147) | RREH LSG (SEQ ID NO: 177) | QSSS LVR (SEQ ID NO: 209) | RKER LAT (SEQ ID NO: 243) | VAHN LTR (SEQ ID NO: 280) | ISHN LAR (SEQ ID NO: 299) |
| ZFP970 | 73 | GATGATGTGG TATTGGGGG (SEQ ID NO: 115) | 742 | 763 | + | RKHH LGR (SEQ ID NO: 148) | RREH LTI (SEQ ID NO: 178) | QSSS LVR (SEQ ID NO: 209) | RKER LAT (SEQ ID NO: 243) | VAHN LTR (SEQ ID NO: 280) | ISHN LAR (SEQ ID NO: 299) |
| ZFP971 | 74 | GATGATGTGG TATTGGGGG (SEQ ID NO: 115) | 742 | 763 | + | RVDH LHR (SEQ ID NO: 147) | RSDH LSL (SEQ ID NO: 179) | QSSS LVR (SEQ ID NO: 209) | RKER LAT (SEQ ID NO: 243) | VAHN LTR (SEQ ID NO: 280) | ISHN LAR (SEQ ID NO: 299) |
| ZFP984 | 75 | GCAGTAGTCG GAACAGGG (SEQ ID NO: 116) | 90 | 107 | − | KTDH LAR (SEQ ID NO: 132) | QKEI LTR (SEQ ID NO: 163) | QSAH LKR (SEQ ID NO: 193) | ETGS LRR (SEQ ID NO: 225) | QSSS LVR (SEQ ID NO: 281) | QTNT LGR (SEQ ID NO: 318) |
| ZFP985 | 76 | GCAGTAGTCG GAACAGGG (SEQ ID NO: 116) | 90 | 107 | − | KKDH LHR (SEQ ID NO: 131) | QKEI LTR (SEQ ID NO: 163) | QSAH LKR (SEQ ID NO: 193) | ETGS LRR (SEQ ID NO: 225) | QSSS LVR (SEç ID NO: 281) | QGGT LRR (SEQ ID NO: 319) |
| ZFP986 | 77 | GCAGTAGTCG GAACAGGG (SEQ ID NO: 116) | 90 | 107 | − | KKDH LHR (SEQ ID NO: 131) | QKEI LTR (SEQ ID NO: 163) | QSAH LKR (SEQ ID NO: 193) | DPTS LNR (SEQ ID NO: 244) | QSSS LVR (SEQ ID NO: 281) | QTNT LGR (SEQ ID NO: 318) |
| ZFP989 | 78 | GCATAGCAGC AGGATGAA (SEQ ID NO: 117) | 409 | 426 | − | QQTN LTR (SEQ ID NO: 145) | VGGN LAR (SEQ ID NO: 180) | KRYN LYQ (SEQ ID NO: 210) | RQDN LNT (SEQ ID NO: 245) | RSHN LKL (SEQ ID NO: 283) | QSTT LKR (SEQ ID NO: 320) |
| ZFP990 | 79 | GCATAGCAGC AGGATGAA (SEQ ID NO: 117) | 409 | 426 | − | QQTN LTR (SEQ ID NO: 145) | VGGN LSR (SEQ ID NO: 181) | KRYN LYQ (SEQ ID NO: 210) | RQDN LNT (SEQ ID NO: 245) | RSHN LRL (SEQ ID NO: 283) | QSTT LKR (SEQ ID NO: 320) |
| ZFP991 | 80 | GCATAGCAGC AGGATGAA (SEQ ID NO: 117) | 409 | 426 | − | QQTN LTR (SEQ ID NO: 145) | VGGN LSR (SEQ ID NO: 181) | KKEN LLQ (SEQ ID NO: 211) | RRDN LKS (SEQ ID NO: 246) | RSHN LKI (SEQ ID NO: 282) | QSTT LKR (SEQ ID NO: 320) |
| ZFP994 | 81 | GGCGTTCACG GTGGTCTCC (SEQ ID | 1612 | 1630 | − | DKSS LRK (SEQ | DHSS LKR (SEQ | RNFI LQR (SEQ | RNDT LII (SEQ | TSTL LKR (SEQ | LKEH LTR (SEQ |

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| | | NO: 118) | | | | ID NO: 149) | ID NO: 182) | ID NO: 212) | ID NO: 247) | ID NO: 284) | ID NO: 321) |
| ZFP995 | 82 | GGCGTTCACG GTGGTCTCC (SEQ ID NO: 118) | 1612 | 1630 | - | CNGS LKK (SEQ ID NO: 150) | DHSS LKR (SEQ ID NO: 182) | RNFI LAR (SEQ ID NO: 213) | RQDI LVV (SEQ ID NO: 248) | HKSS LTR (SEQ ID NO: 285) | ESGH LKR (SEQ ID NO: 301) |
| ZFP996 | 83 | GGCGTTCACG GTGGTCTCC (SEQ ID NO: 118) | 1612 | 1630 | - | CNGS LKK (SEQ ID NO: 150) | DHSS LKR (SEQ ID NO: 182) | RNFI LAR (SEQ ID NO: 213) | RQDI LVV (SEQ ID NO: 248) | TSTL LKR (SEQ ID NO: 284) | LKEH LTR (SEQ ID NO: 321) |
| ZFP999 | 84 | GTTGGTGAGT GATTGGAG (SEQ ID NO: 119) | 327 | 344 | - | TNNN LAR (SEQ ID NO: 151) | RTDS LTL (SEQ ID NO: 183) | QREH LTT (SEQ ID NO: 214) | RRDN LNR (SEQ ID NO: 233) | RRQK LTI (SEQ ID NO: 286) | HKSS LTR (SEQ ID NO: 322) |
| ZFP1000 | 85 | GTTGGTGAGT GATTGGAG (SEQ ID NO: 119) | 327 | 344 | - | TNNN LAR (SEQ ID NO: 151) | RTDS LTL (SEQ ID NO: 183) | QREH LTT (SEQ ID NO: 214) | RGDN LKR (SEQ ID NO: 249) | RRQK LTI (SEQ ID NO: 286) | HKSS LTR (SEQ ID NO: 322) |
| ZFP1001 | 86 | GTTGGTGAGT GATTGGAG (SEQ ID NO: 119) | 327 | 344 | - | TNNN LAR (SEQ ID NO: 151) | RTDS LTL (SEQ ID NO: 183) | QREH LNG (SEQ ID NO: 215) | RGDN LAR (SEQ ID NO: 250) | RRQK LTI (SEQ ID NO: 286) | HKSS LTR (SEQ ID NO: 322) |
| ZFP1005 | 87 | GGAGGTTGGG GACTGCGAA (SEQ ID NO: 120) | 312 | 330 | - | QQTN LTR (SEQ ID NO: 145) | ANRT LVH (SEQ ID NO: 174) | DPAN LRR (SEQ ID NO: 216) | RQEH LVR (SEQ ID NO: 251) | MKHH LGR (SEQ ID NO: 287) | QNSH LRR (SEQ ID NO: 323) |
| ZFP1006 | 88 | GGAGGTTGGG GACTGCGAA (SEQ ID NO: 120) | 312 | 330 | - | QQTN LTR (SEQ ID NO: 145) | ANRT LVH (SEQ ID NO: 174) | EEAN LRR (SEQ ID NO: 207) | RREH LVR (SEQ ID NO: 241) | MKHH LGR (SEQ ID NO: 287) | QNSH LRR (SEQ ID NO: 323) |
| ZFP1007 | 89 | GGAGGTTGGG GACTGCGAA (SEQ ID NO: 120) | 312 | 330 | - | QQTN LTR (SEQ ID NO: 145) | ANRT LVH (SEQ ID NO: 174) | DPAN LRR (SEQ ID NO: 216) | RQEH LVR (SEQ ID NO: 251) | LKQH LVR (SEQ ID NO: 288) | QGGH LAR (SEQ ID NO: 324) |
| ZFP1008 | 90 | GGATGATGTG GTATTGGGG (SEQ ID NO: 121) | 741 | 762 | + | RNTH LAR (SEQ ID NO: 152) | RADV LKG (SEQ ID NO: 175) | QRSS LVR (SEQ ID NO: 208) | RKDA LHV (SEQ ID NO: 242) | QNEH LKV (SEQ ID NO: 289) | QNSH LRR (SEQ ID NO: 323) |
| ZFP1009 | 91 | GGATGATGTG GTATTGGGG (SEQ ID NO: 121) | 741 | 762 | + | RNTH LAR (SEQ ID NO: 152) | RADV LKG (SEQ ID NO: 175) | QSSS LVR (SEQ ID NO: 209) | RKER LAT (SEQ ID NO: 243) | QKTH LAV (SEQ ID NO: 290) | QGGH LKR (SEQ ID NO: 325) |

TABLE 18-continued sequence listing.

| ZFP | SEQ ID | Target Sequence | Start | End | Strd | F1 | F2 | F3 | F4 | F5 | F6 |
|---|---|---|---|---|---|---|---|---|---|---|---|
| ZFP1010 | 92 | GGATGATGTG GTATTGGGG (SEQ ID NO: 121) | 741 | 762 | + | RNTH LAR (SEQ ID NO: 152) | RADV LKG (SEQ ID NO: 175) | QSSS LVR (SEQ ID NO: 209) | RKER LAT (SEQ ID NO: 243) | QKTH LAV (SEQ ID NO: 290) | QNSH LRR (SEQ ID NO: 323) |
| ZFP1013 | 93 | GGATGTGTCT GCGGCGTT (SEQ ID NO: 122) | 375 | 395 | + | HKSS LTR (SEQ ID NO: 153) | ESGH LKR (SEQ ID NO: 184) | RRRN LTL (SEQ ID NO: 217) | DRSS LKR (SEQ ID NO: 252) | QPHS LAV (SEQ ID NO: 291) | QKPH LSR (SEQ ID NO: 326) |
| ZFP1014 | 94 | GGATGTGTCT GCGGCGTT (SEQ ID NO: 122) | 375 | 395 | + | HKSS LTR (SEQ ID NO: 153) | EGGH LKR (SEQ ID NO: 185) | RRRN LQL (SEQ ID NO: 218) | DHSS LKR (SEQ ID NO: 229) | RRQH LQY (SEQ ID NO: 292) | QSAH LKR (SEQ ID NO: 327) |
| ZFP1015 | 95 | GGATGTGTCT GCGGCGTT (SEQ ID NO: 122) | 375 | 395 | + | HKSS LTR (SEQ ID NO: 153) | EGGH LKR (SEQ ID NO: 185) | RRRN LTL (SEQ ID NO: 217) | DRSS LKR (SEQ ID NO: 252) | RRQH LQY (SEQ ID NO: 292) | QSAH LKR (SEQ ID NO: 327) |
| ZFP1018 | 96 | GGGGGTTGCG TCAGCAAAC (SEQ ID NO: 123) | 1184 | 1202 | − | GHTA LRN (SEQ ID NO: 154) | QSGT LHR (SEQ ID NO: 186) | DHSS LKR (SEQ ID NO: 199) | AMRS LMG (SEQ ID NO: 253) | RRSR LVR (SEQ ID NO: 293) | RGEH LTR (SEQ ID NO: 328) |
| ZFP1019 | 97 | GGGGGTTGCG TCAGCAAAC (SEQ ID NO: 123) | 1184 | 1202 | − | GHTA LRN (SEQ ID NO: 154) | QSTT LKR (SEQ ID NO: 187) | DHSS LKR (SEQ ID NO: 199) | QQRS LVG (SEQ ID NO: 254) | EAHH LSR (SEQ ID NO: 294) | RTEH LAR (SEQ ID NO: 329) |
| ZFP1020 | 98 | GGGGGTTGCG TCAGCAAAC (SEQ ID NO: 123) | 1184 | 1202 | − | GHTA LRN (SEQ ID NO: 154) | QSTT LKR (SEQ ID NO: 187) | DHSS LKR (SEQ ID NO: 199) | AMRS LMG (SEQ ID NO: 253) | RQSR LQR (SEQ ID NO: 295) | RREH LVR (SEQ ID NO: 330) |
| ZFP1023 | 99 | GTTGTTAGAC GACGAGGCA (SEQ ID NO: 124) | 2342 | 2363 | + | QGET LKR (SEQ ID NO: 155) | RADN LRR (SEQ ID NO: 188) | DKAN LIR (SEQ ID NO: 219) | DQGN LIR (SEQ ID NO: 255) | HRHV LIN (SEQ ID NO: 296) | TNSS LTR (SEQ ID NO: 331) |
| ZFP1024 | 100 | GTTGTTAGAC GACGAGGCA (SEQ ID NO: 124) | 2342 | 2363 | + | QGET LKR (SEQ ID NO: 155) | RADN LRR (SEQ ID NO: 188) | DSSN LRR (SEQ ID NO: 220) | DQGN LIR (SEQ ID NO: 255) | HKSS LTR (SEQ ID NO: 285) | IRTS LKR (SEQ ID NO: 332) |
| ZFP1025 | 101 | GTTGTTAGAC GACGAGGCA (SEQ ID NO: 124) | 2342 | 2363 | + | QGET LKR (SEQ ID NO: 155) | RADN LRR (SEQ ID NO: 188) | EQGN LLR (SEQ ID NO: 221) | DGGN LGR (SEQ ID NO: 256) | HRHV LIN (SEQ ID NO: 296) | TNSS LTR (SEQ ID NO: 331) |

In some embodiments, the ZFP domain of the present epigenetic editor binds to a target sequence provided herein. In further embodiments, the ZFP domain comprises, in order, the F1-F6 amino acid sequences of any one of the zinc finger proteins as shown in Table 1 and Table 18. The F1-F6 amino acid sequences may be placed within the ZF framework sequence of SEQ ID NOs: 1084 and 1258-1259, or within any other ZF framework known in the art.

C. TALEs

In some embodiments, the DNA-binding domain of an epigenetic editor described herein comprises a transcription activator-like effector (TALE) domain. The DNA-binding domain of a TALE comprises a highly conserved sequence of about 33-34 amino acids, with a repeat variable di-residue (RVD) at positions 12 and 13 that is central to the recognition of specific nucleotides. TALEs can be engineered to bind practically any desired DNA sequence. Methods for programming TALEs are known in the art. For example, such methods are described in Carroll et al., *Genet Soc Amer.* (2011) 188(4):773-82; Miller et al., *Nat Biotechnol.* (2007) 25(7):778-85; Christian et al., *Genetics* (2008) 186 (2):757-61; Li et al., *Nucl Acids Res.* (2010) 39(1):359-72; and Moscou et al., *Science* (2009) 326(5959):1501.

D. Other DNA-Binding Domains

Other DNA-binding domains are contemplated for the epigenetic editors described herein. In some embodiments, the DNA-binding domain comprises an argonaute protein domain, e.g., from *Natronobacterium gregoryi* (NgAgo). NgAgo is a ssDNA-guided endonuclease that is guided to its target site by 5' phosphorylated ssDNA (gDNA), where it produces double-strand breaks. In contrast to Cas9, the NgAgo-gDNA system does not require a protospacer-adjacent motif (PAM). Thus, using a nuclease inactive NgAgo (dNgAgo) can greatly expand the bases that may be targeted. The characterization and use of NgAgo have been described, e.g., in Gao et al., *Nat Biotechnol.* (2016) 34(7):768-73; Swarts et al., *Nature* (2014) 507(7491):258-61; and Swarts et al., *Nucl Acids Res.* (2015) 43(10):5120-9.

In some embodiments, the DNA-binding domain comprises an inactivated nuclease, for example, an inactivated meganuclease. Additional non-limiting examples of DNA-binding domains include tetracycline-controlled repressor (tetR) DNA-binding domains, leucine zippers, helix-loop-helix (HLH) domains, helix-turn-helix domains, β-sheet motifs, steroid receptor motifs, bZIP domains homeodomains, and AT-hooks.

II. Guide Polynucleotides

Epigenetic editors described herein that comprise a polynucleotide guided DNA-binding domain may also include a guide polynucleotide that is capable of forming a complex with the DNA-binding domain. The guide polynucleotide may comprise RNA, DNA, or a mixture of both. For example, where the polynucleotide guided DNA-binding domain is a CRISPR-associated protein domain, the guide polynucleotide may be a guide RNA (gRNA). A "guide RNA" or "gRNA" refers to a nucleic acid that is able to hybridize to a target sequence and direct binding of the CRISPR-Cas complex to the target sequence. Methods of using guide polynucleotide sequences with programmable DNA-binding proteins (e.g., CRISPR-associated protein domains) for site-specific DNA targeting (e.g., to modify a genome) are known in the art.

A guide polynucleotide sequence (e.g., a gRNA sequence) may comprises two parts: 1) a nucleotide sequence comprising a "targeting sequence" that is complementary to a target nucleic acid sequence ("target sequence"), e.g., to a nucleic acid sequence comprised in a genomic target site; and 2) a nucleotide sequence that binds a polynucleotide guided DNA-binding domain (e.g., a CRISPR-Cas protein domain). The nucleotide sequence in 1) may comprise a targeting sequence that is 100% complementary to a genomic nucleic acid sequence, e.g., a nucleic acid sequence comprised in a genomic target site, and thus may hybridize to the target nucleic acid sequence. The nucleotide sequence in 1) may be referred to as, e.g., a crispr RNA, or crRNA. The nucleotide sequence in 2) may be referred to as a scaffold sequence of a guide nucleic acid, e.g., a tracrRNA, or an activating region of a guide nucleic acid, and may comprise a stem-loop structure. Parts 1) and 2) as described above may be fused to form one single guide (e.g., a single guide RNA, or sgRNA), or may be on two separate nucleic acid molecules. In some embodiments, a guide polynucleotide comprises parts 1) and 2) connected by a linker. In some embodiments, a guide polynucleotide comprises parts 1) and 2) connected by a non-nucleic acid linker, for example, a peptide linker or a chemical linker.

Part 2 (the scaffold sequence) of a guide polynucleotide as described herein may be, for example, as described in Jinek et al., *Science* (2012) 337:816-21; U.S. Patent Publication 2016/0208288; or U.S. Patent Publication 2016/0200779. Variants of part 2) are also contemplated by the present disclosure. For example, the tetraloop and stem loop of a gRNA scaffold (tracrRNA) sequence may be modified to include RNA aptamers, which can be bound by specific protein domains. In some embodiments, such modified gRNAs can be used to facilitate the recruitment of repressive or activating domains fused to the protein-interacting RNA aptamers.

A gRNA as provided herein typically comprises a targeting domain and a binding domain. The targeting domain (also termed "targeting sequence") may comprise a nucleic acid sequence that binds to a target site, e.g., to a genomic nucleic acid molecule within a cell. The target site may be a double-stranded DNA sequence comprising a PAM sequence as well as the target sequence, which is located on the same strand as, and directly adjacent to, the PAM sequence. The targeting domain of the gRNA may comprise an RNA sequence that corresponds to the target sequence, i.e., it resembles the sequence of the target domain, sometimes with one or more mismatches, but typically comprising an RNA sequence instead of a DNA sequence. The targeting domain of the gRNA thus may base pair (in full or partial complementarity) with the sequence of the double-stranded target site that is complementary to the target sequence, and thus with the strand complementary to the strand that comprises the PAM sequence. It will be understood that the targeting domain of the gRNA typically does not include a sequence that resembles the PAM sequence. It will further be understood that the location of the PAM may be 5' or 3' of the target sequence, depending on the nuclease employed. For example, the PAM is typically 3' of the target sequence for Cas9 nucleases, and 5' of the target sequence for Cas12a nucleases. For an illustration of the location of the PAM and the mechanism of gRNA binding to a target site, see, e.g., FIG. 1 of Vanegas et al., *Fungal Biol Biotechnol.* (2019) 6:6, which is incorporated by reference herein. For additional illustration and description of the mechanism of gRNA targeting of an RNA-guided nuclease to a target site, see Fu et al., *Nat Biotechnol* (2014) 32(3): 279-84 and Stemnberg et al., *Nature* (2014) 507(7490):62-7, each incorporated herein by reference.

In some embodiments, the targeting domain sequence comprises between 17 and 30 nucleotides and corresponds fully to the target sequence (i.e., without any mismatch nucleotides). In some embodiments, however, the targeting domain sequence may comprise one or more, but typically not more than 4, mismatches, e.g., 1, 2, 3, or 4 mismatches. As the targeting domain is part of gRNA, which is an RNA molecule, it will typically comprise ribonucleotides, while the DNA targeting domain will comprise deoxyribonucleotides.

An exemplary illustration of a Cas9 target site, comprising a 22 nucleotide target domain, and an NGG PAM sequence, as well as of a gRNA comprising a targeting domain that fully corresponds to the target sequence (and thus base pairs with full complementarity with the DNA strand complementary to the strand comprising the target sequence and PAM) is provided below:

ments, the targeting domain of a gRNA provided herein comprises 1 mismatch relative to a target sequence provided herein. In some embodiments, the targeting domain comprises 2 mismatches relative to the target sequence. In some embodiments, the target domain comprises 3 mismatches relative to the target sequence.

Methods for designing, selecting, and validating gRNAs are described herein and known in the art. Software tools can be used to optimize the gRNAs corresponding to a target DNA sequence, e.g., to minimize total off-target activity across the genome. For example, DNA sequence searching algorithms can be used to identify a target sequence in crRNAs of a gRNA for use with Cas9. Exemplary gRNA design tools include the ones described in Bae et al., *Bioinformatics* (2014) 30:1473-5.

Guide polynucleotides (e.g., gRNAs) described herein may be of various lengths. In some embodiments, the length

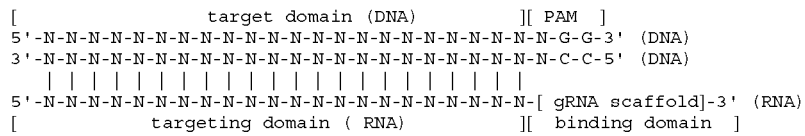

An exemplary illustration of a Cas12a target site, comprising a 22 nucleotide target domain, and a TTN PAM sequence, as well as of a gRNA comprising a targeting domain that fully corresponds to the target sequence (and thus base pairs with full complementarity with the DNA strand complementary to the strand comprising the target sequence and PAM) is provided below:

of the spacer or targeting sequence depends on the CRISPR-associated protein component of the epigenetic editor system used. For example, Cas proteins from different bacterial species have varying optimal targeting sequence lengths. Accordingly, the spacer sequence may comprise, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39,

While not wishing to be bound by theory, at least in some embodiments, it is believed that the length and complementarity of the targeting domain with the target sequence contributes to specificity of the interaction of the gRNA/Cas9 molecule complex with a target nucleic acid. In some embodiments, the targeting domain of a gRNA provided herein is 5 to 50 nucleotides in length. In some embodiments, the targeting domain is 15 to 25 nucleotides in length. In some embodiments, the targeting domain is 18 to 22 nucleotides in length. In some embodiments, the targeting domain is 19-21 nucleotides in length. In some embodiments, the targeting domain is 15 nucleotides in length. In some embodiments, the targeting domain is 16 nucleotides in length. In some embodiments, the targeting domain is 17 nucleotides in length. In some embodiments, the targeting domain is 18 nucleotides in length. In some embodiments, the targeting domain is 19 nucleotides in length. In some embodiments, the targeting domain is 20 nucleotides in length. In some embodiments, the targeting domain is 21 nucleotides in length. In some embodiments, the targeting domain is 22 nucleotides in length. In some embodiments, the targeting domain is 23 nucleotides in length. In some embodiments, the targeting domain is 24 nucleotides in length. In some embodiments, the targeting domain is 25 nucleotides in length. In certain embodiments, the targeting domain fully corresponds, without mismatch, to a target sequence provided herein, or a part thereof. In some embodi- 40, 41, 42, 43, 44, 45, 46, 47, 48, 49, 50, or more than 50 nucleotides in length. In some embodiments, the spacer comprises 10-24, 11-20, 11-16, 18-24, 19-21, or 20 nucleotides in length. In some embodiments, a guide polynucleotide (e.g., gRNA) is from 15-100 (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50) nucleotides in length and comprises a spacer sequence of at least 10 (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50) contiguous nucleotides complementary to the target sequence. In some embodiments, a guide polynucleotide described herein may be truncated, e.g., by 1, 2, 3, 4, 5, 10, 15, 20, 25, 30, 40, 50 or more nucleotides.

In certain embodiments, the 3' end of the HBV target sequence is immediately adjacent to a PAM sequence (e.g., a canonical PAM sequence such as NGG for SpCas9). The degree of complementarity between the targeting sequence of the guide polynucleotide (e.g., the spacer sequence of a gRNA) and the target sequence may be at least 90%, 91%, 92%, 93%, 94%, 95%, 96%, 97%, 98%, 99%, or 100%. In particular embodiments, the targeting and the target sequence may be 100% complementary. In other embodiments, the targeting sequence and the target sequence may contain, e.g., 1, 2, 3, 4, 5, 6, 7, 8, 9, or 10 mismatches.

A guide polynucleotide (e.g., gRNA) may be modified with, for example, chemical alterations and synthetic modifications. A modified gRNA, for instance, can include an alteration or replacement of one or both of the non-linking phosphate oxygens and/or of one or more of the linking phosphate oxygens in the phosphodiester backbone linkage, an alteration of the ribose sugar (e.g., of the 2' hydroxyl on the ribose sugar), an alteration of the phosphate moiety, modification or replacement of a naturally occurring nucleobase, modification or replacement of the ribose-phosphate backbone, modification of the 3' end and/or 5' end of the oligonucleotide, replacement of a terminal phosphate group or conjugation of a moiety, cap, or linker, or any combination thereof.

In some embodiments, one or more ribose groups of the gRNA may be modified. Examples of chemical modifications to the ribose group include, but are not limited to, 2'-O-methyl (2'-OMe), 2'-fluoro (2'-F), 2'-deoxy, 2'-O-(2-methoxyethyl) (2'-MOE), 2'-NH2,2'-O-allyl, 2'-O-ethylamine, 2'-O-cyanoethyl, 2'-O-acetalester, or a bicyclic nucleotide such as locked nucleic acid (LNA), 2'-(5-constrained ethyl (S-cEt)), constrained MOE, or 2'-0,4'-C-aminomethylene bridged nucleic acid (2',4'-BNANC). 2'-O-methyl modification and/or 2'-fluoro modification may increase binding affinity and/or nuclease stability of the gRNA oligonucleotides.

In some embodiments, one or more phosphate groups of the gRNA may be chemically modified. Examples of chemical modifications to a phosphate group include, but are not limited to, a phosphorothioate (PS), phosphonoacetate (PACE), thiophosphonoacetate (thioPACE), amide, triazole, phosphonate, and phosphotriester modification. In some embodiments, a guide polynucleotide described herein may comprise one, two, three, or more PS linkages at or near the 5' end and/or the 3' end; the PS linkages may be contiguous or noncontiguous.

In some embodiments, the gRNA herein comprises a mixture of ribonucleotides and deoxyribonucleotides and/or one or more PS linkages.

In some embodiments, one or more nucleobases of the gRNA may be chemically modified. Examples of chemically modified nucleobases include, but are not limited to, 2-thiouridine, 4-thiouridine, N6-methyladenosine, pseudouridine, 2,6-diaminopurine, inosine, thymidine, 5-methylcytosine, 5-substituted pyrimidine, isoguanine, isocytosine, and nucleobases with halogenated aromatic groups. Chemical modifications can be made in the spacer region, the tracr RNA region, the stem loop, or any combination thereof.

Table 2 below lists exemplary target sequences for epigenetic modification of HBV, as well as the coordinates of the start and end positions of the targeted site on the HBV genome.

TABLE 2

Targeting Domain Sequences of Exemplary gRNAs Targeting HBV. The following target sites were identified as suitable for targeting with an epigenetic repressor:

| SEQ IDs | Target domain sequence | Start | End | Strand |
|---|---|---|---|---|
| 333 | CCTGCTGGTGGCTCCAGTTC | 57 | 77 | + |
| 334 | CTGAACTGGAGCCACCAGCA | 59 | 79 | - |
| 335 | CCTGAACTGGAGCCACCAGC | 60 | 80 | - |
| 336 | CCTCGAGAAGATTGACGATA | 115 | 135 | - |
| 337 | TCGTCAATCTTCTCGAGGAT | 117 | 137 | + |
| 338 | CGTCAATCTTCTCGAGGATT | 118 | 138 | + |
| 339 | GTCAATCTTCTCGAGGATTG | 119 | 139 | + |
| 340 | AACATGGAGAACATCACATC | 153 | 173 | + |
| 341 | AACATCACATCAGGATTCCT | 162 | 182 | + |
| 342 | CTAGACTCTGCGGTATTGTG | 233 | 253 | - |
| 343 | TACCGCAGAGTCTAGACTCG | 238 | 258 | + |
| 344 | CGCAGAGTCTAGACTCGTGG | 241 | 261 | + |
| 345 | CACCACGAGTCTAGACTCTG | 243 | 263 | - |
| 346 | TGGACTTCTCTCAATTTTCT | 261 | 281 | + |
| 347 | GGACTTCTCTCAATTTTCTA | 262 | 282 | + |
| 348 | GACTTCTCTCAATTTTCTAG | 263 | 283 | + |
| 349 | ACTTCTCTCAATTTTCTAGG | 264 | 284 | + |
| 350 | CGAATTTTGGCCAAGACACA | 295 | 315 | - |
| 351 | AGGTTGGGGACTGCGAATTT | 309 | 328 | - |
| 352 | GGCATAGCAGCAGGATGAAG | 408 | 427 | - |
| 353 | AGAAGATGAGGCATAGCAGC | 417 | 436 | - |
| 354 | GCTATGCCTCATCTTCTTGT | 420 | 439 | + |
| 355 | GAAGAACCAACAAGAAGATG | 429 | 448 | - |
| 356 | CATCTTCTTGTTGGTTCTTC | 429 | 448 | + |
| 357 | CCCGTTTGTCCTCTAATTCC | 469 | 488 | + |
| 358 | CCTGGAATTAGAGGACAAAC | 472 | 491 | - |
| 359 | TCCTGGAATTAGAGGACAAA | 473 | 492 | - |
| 360 | TACTAGTGCCATTTGTTCAG | 680 | 699 | + |
| 361 | CCATTTGTTCAGTGGTTCGT | 688 | 707 | + |
| 362 | CATTTGTTCAGTGGTTCGTA | 689 | 708 | + |
| 363 | CCTACGAACCACTGAACAAA | 691 | 710 | - |
| 364 | TTTCAGTTATATGGATGATG | 731 | 750 | + |
| 365 | CAAAAGAAAATTGGTAACAG | 799 | 818 | - |
| 366 | TACCAATTTTCTTTTGTCTT | 803 | 822 | + |
| 367 | ACCAATTTTCTTTTGTCTTT | 804 | 823 | + |
| 368 | ACCCAAAGACAAAAGAAAAT | 808 | 827 | - |
| 369 | TGACATACTTTCCAATCAAT | 975 | 994 | - |
| 370 | CACTTTCTCGCCAACTTACA | 1093 | 1113 | + |
| 371 | CACAGAAAGGCCTTGTAAGT | 1106 | 1126 | - |

TABLE 2-continued

Targeting Domain Sequences of Exemplary gRNAs Targeting HBV. The following target sites were identified as suitable for targeting with an epigenetic repressor:

| SEQ IDs | Target domain sequence | Start | End | Strand |
|---|---|---|---|---|
| 372 | TGAACCTTTACCCCGTTGCC | 1137 | 1157 | + |
| 373 | GGGCAACGGGGTAAAGGTTC | 1138 | 1158 | − |
| 374 | TTTACCCCGTTGCCCGGCAA | 1143 | 1163 | + |
| 375 | GTTGCCGGGCAACGGGGTAA | 1144 | 1164 | − |
| 376 | CCCGTTGCCCGGCAACGGCC | 1148 | 1168 | + |
| 377 | CTGGCCGTTGCCGGGCAACG | 1150 | 1170 | − |
| 378 | CCTGGCCGTTGCCGGGCAAC | 1151 | 1171 | − |
| 379 | ACCTGGCCGTTGCCGGGCAA | 1152 | 1172 | − |
| 380 | GCACAGACCTGGCCGTTGCC | 1158 | 1178 | − |
| 381 | GGCACAGACCTGGCCGTTGC | 1159 | 1179 | − |
| 382 | GCAAACACTTGGCACAGACC | 1169 | 1189 | − |
| 383 | GGGTTGCGTCAGCAAACACT | 1180 | 1200 | − |
| 384 | TTTGCTGACGCAACCCCCAC | 1184 | 1204 | + |
| 385 | CTGACGCAACCCCCACTGGC | 1188 | 1208 | + |
| 386 | TGACGCAACCCCCACTGGCT | 1189 | 1209 | + |
| 387 | GACGCAACCCCCACTGGCTG | 1190 | 1210 | + |
| 388 | AACCCCCACTGGCTGGGGCT | 1195 | 1215 | + |
| 389 | TCCTCTGCCGATCCATACTG | 1255 | 1275 | + |
| 390 | TCCGCAGTATGGATCGGCAG | 1259 | 1279 | − |
| 391 | AGGAGTTCCGCAGTATGGAT | 1265 | 1285 | − |
| 392 | CGGCTAGGAGTTCCGCAGTA | 1270 | 1290 | − |
| 393 | TGCGAGCAAAACAAGCGGCT | 1285 | 1305 | − |
| 394 | CCGCTTGTTTTGCTCGCAGC | 1287 | 1307 | + |
| 395 | CCTGCTGCGAGCAAAACAAG | 1290 | 1310 | − |
| 396 | TGTTTTGCTCGCAGCAGGTC | 1292 | 1312 | + |
| 397 | GCAGCACAGCCTAGCAGCCA | 1376 | 1396 | − |
| 398 | TGCTAGGCTGTGCTGCCAAC | 1380 | 1400 | + |
| 399 | GCTGCCAACTGGATCCTGCG | 1391 | 1411 | + |
| 400 | CTGCCAACTGGATCCTGCGC | 1392 | 1412 | + |
| 401 | CGTCCCGCGCAGGATCCAGT | 1398 | 1418 | − |
| 402 | AAACAAAGGACGTCCCGCGC | 1408 | 1428 | − |
| 403 | GTCCTTTGTTTACGTCCCGT | 1417 | 1437 | + |
| 404 | CGCCGACGGGACGTAAACAA | 1422 | 1442 | − |
| 405 | TGCCGTTCCGACCGACCACG | 1504 | 1523 | + |
| 406 | AGGTGCGCCCCGTGGTCGGT | 1513 | 1533 | − |
| 407 | AGAGAGGTGCGCCCCGTGGT | 1517 | 1537 | − |
| 408 | GTAAAGAGAGGTGCGCCCCG | 1521 | 1541 | − |
| 409 | GGGGCGCACCTCTCTTTACG | 1522 | 1542 | + |
| 410 | CGGGGAGTCCGCGTAAAGAG | 1533 | 1553 | − |
| 411 | CAGATGAGAAGGCACAGACG | 1551 | 1571 | − |
| 412 | GTCTGTGCCTTCTCATCTGC | 1552 | 1572 | + |
| 413 | GGCAGATGAGAAGGCACAGA | 1553 | 1573 | − |
| 414 | GCAGATGAGAAGGCACAGAC | 1553 | 1572 | − |
| 415 | ACACGGTCCGGCAGATGAGA | 1562 | 1582 | − |
| 416 | GAAGCGAAGTGCACACGGTC | 1574 | 1594 | − |
| 417 | GAGGTGAAGCGAAGTGCACA | 1579 | 1599 | − |
| 418 | CTTCACCTCTGCACGTCGCA | 1590 | 1610 | + |
| 419 | GGTCTCCATGCGACGTGCAG | 1598 | 1618 | − |
| 420 | TGCCCAAGGTCTTACATAAG | 1640 | 1660 | + |
| 421 | GTCCTCTTATGTAAGACCTT | 1645 | 1665 | − |
| 422 | AGTCCTCTTATGTAAGACCT | 1646 | 1666 | − |
| 423 | GTCTTACATAAGAGGACTCT | 1648 | 1668 | + |
| 424 | AATGTCAACGACCGACCTTG | 1680 | 1700 | + |
| 425 | TTTGAAGTATGCCTCAAGGT | 1694 | 1714 | − |
| 426 | AGTCTTTGAAGTATGCCTCA | 1698 | 1718 | − |
| 427 | AAGACTGTTTGTTTAAAGAC | 1712 | 1732 | + |
| 428 | AGACTGTTTGTTTAAAGACT | 1713 | 1733 | + |
| 429 | CTGTTTGTTTAAAGACTGGG | 1716 | 1736 | + |
| 430 | GTTTAAAGACTGGGAGGAGT | 1722 | 1742 | + |
| 431 | TCTTTGTACTAGGAGGCTGT | 1766 | 1786 | + |
| 432 | AGGAGGCTGTAGGCATAAAT | 1776 | 1796 | + |
| 433 | GTGAAAAAGTTGCATGGTGC | 1810 | 1830 | − |
| 434 | GCAGAGGTGAAAAAGTTGCA | 1816 | 1836 | − |
| 435 | AACAAGAGATGATTAGGCAG | 1832 | 1852 | + |
| 436 | GACATGAACAAGAGATGATT | 1838 | 1858 | − |
| 437 | AGCTTGGAGGCTTGAACAGT | 1860 | 1880 | − |
| 438 | CAAGCCTCCAAGCTGTGCCT | 1866 | 1886 | + |
| 439 | AAGCCTCCAAGCTGTGCCTT | 1867 | 1887 | + |
| 440 | CCTCCAAGCTGTGCCTTGGG | 1871 | 1890 | + |
| 441 | CCACCCAAGGCACAGCTTGG | 1873 | 1893 | − |
| 442 | AGCTGTGCCTTGGGTGGCTT | 1876 | 1896 | + |
| 443 | AAGCCACCCAAGGCACAGCT | 1876 | 1896 | − |

TABLE 2-continued

Targeting Domain Sequences of Exemplary gRNAs Targeting HBV. The following target sites were identified as suitable for targeting with an epigenetic repressor:

| SEQ IDs | Target domain sequence | Start | End | Strand |
|---|---|---|---|---|
| 444 | GCTGTGCCTTGGGTGGCTTT | 1877 | 1897 | + |
| 445 | CTGTGCCTTGGGTGGCTTTG | 1878 | 1898 | + |
| 446 | TAGCTCCAAATTCTTTATAA | 1916 | 1936 | − |
| 447 | GTAGCTCCAAATTCTTTATA | 1917 | 1937 | − |
| 448 | TAAAGAATTTGGAGCTACTG | 1919 | 1939 | + |
| 449 | ATGACTCTAGCTACCTGGGT | 2097 | 2117 | + |
| 450 | CACATTTCTTGTCTCACTTT | 2211 | 2231 | + |
| 451 | TAGTTTCCGGAAGTGTTGAT | 2321 | 2341 | − |
| 452 | CGTCTAACAACAGTAGTTTC | 2334 | 2354 | − |
| 453 | ACTACTGTTGTTAGACGACG | 2337 | 2357 | + |
| 454 | CTGTTGTTAGACGACGAGGC | 2341 | 2361 | + |
| 455 | CGAGGGAGTTCTTCTTCTAG | 2368 | 2388 | − |
| 456 | GCGAGGGAGTTCTTCTTCTA | 2369 | 2389 | − |
| 457 | GGCGAGGGAGTTCTTCTTCT | 2370 | 2390 | − |
| 458 | CTCCCTCGCCTCGCAGACGA | 2380 | 2400 | + |
| 459 | GACCTTCGTCTGCGAGGCGA | 2385 | 2405 | − |
| 460 | AGACCTTCGTCTGCGAGGCG | 2386 | 2406 | − |
| 461 | GATTGAGACCTTCGTCTGCG | 2391 | 2411 | − |
| 462 | GATTGAGATCTTCTGCGACG | 2415 | 2435 | − |
| 463 | GTCGCAGAAGATCTCAATCT | 2416 | 2436 | + |
| 464 | TCGCAGAAGATCTCAATCTC | 2417 | 2437 | + |
| 465 | ATATGGTGACCCACAAAATG | 2807 | 2827 | − |
| 466 | TTTGTGGGTCACCATATTCT | 2810 | 2830 | + |
| 467 | TTGTGGGTCACCATATTCTT | 2811 | 2831 | + |
| 468 | GCTGGATCCAACTGGTGGTC | 2894 | 2914 | − |
| 469 | CACCCCAAAAGGCCTCCGTG | 3026 | 3046 | − |
| 470 | CCTTTTGGGGTGGAGCCCTC | 3034 | 3054 | + |
| 471 | CCTGAGGGCTCCACCCCAAA | 3037 | 3057 | − |
| 472 | GGGGTGGAGCCCTCAGGCTC | 3040 | 3060 | + |
| 473 | GGGTGGAGCCCTCAGGCTCA | 3041 | 3061 | + |
| 474 | CGATTGGTGGAGGCAGGAGG | 3092 | 3112 | − |
| 475 | CTCATCCTCAGGCCATGCAG | 3159 | 3179 | + |
| 102 | GATGAGGCATAGCAGCAG | 415 | 432 | − |
| 103 | GATGATTAGGCAGAGGTG | 1828 | 1845 | − |
| 104 | GGATTCAGCGCCGACGGG | 1433 | 1450 | − |
| 105 | GGCAGTAGTCGGAACAGGG | 90 | 108 | − |
| 106 | GTAAACTGAGCCAGGAGAA | 664 | 682 | − |
| 107 | ACGGTGGTCTCCATGCGAC | 1605 | 1623 | − |
| 108 | GCTGGATGTGTCTGCGGCG | 372 | 393 | + |
| 109 | GTCTGCGAGGCGAGGGAG | 2381 | 2398 | − |
| 110 | GTTGCCGGGCAACGGGGTA | 1146 | 1164 | − |
| 111 | CGAGAAAGTGAAAGCCTGC | 1085 | 1103 | − |
| 112 | GAGGCTTGAACAGTAGGAC | 1856 | 1874 | − |
| 113 | GAGGTTGGGGACTGCGAA | 312 | 329 | − |
| 114 | GATGATGTGGTATTGGGG | 742 | 762 | + |
| 115 | GATGATGTGGTATTGGGGG | 742 | 763 | + |
| 116 | GCAGTAGTCGGAACAGGG | 90 | 107 | − |
| 117 | GCATAGCAGCAGGATGAA | 409 | 426 | − |
| 118 | GGCGTTCACGGTGGTCTCC | 1612 | 1630 | − |
| 119 | GTTGGTGAGTGATTGGAG | 327 | 344 | − |
| 120 | GGAGGTTGGGGACTGCGAA | 312 | 330 | − |
| 121 | GGATGATGTGGTATTGGGG | 741 | 762 | + |
| 122 | GGATGTGTCTGCGGCGTT | 375 | 395 | + |
| 123 | GGGGGTTGCGTCAGCAAAC | 1184 | 1202 | − |
| 124 | GTTGTTAGACGACGAGGCA | 2342 | 2363 | + |

Target domains identified above that are adjacent to a PAM sequence, e.g., an *S. pyogenes* Cas9 PAM sequence, can be targeted by a CRISPR-based epigenetic repressor, e.g., an epigenetic repressor comprising a dCas9 DNA-binding domain. For example, target sites 1-143 are suitable for dCas9-based epigenetic repressor targeting.

A suitable gRNA for targeting any of the target domain sequences would, in some embodiments, comprise a target domain sequence that is the RNA-equivalent sequence of the provided DNA sequence of the targeting domain sequence (i.e., an RNA nucleotide of that sequence instead of the provided DNA nucleotide, with uracil instead of thymine), and a suitable tracr RNA sequence.

Any tracr sequence known in the art is contemplated for a gRNA described herein. In some embodiments, a gRNA described herein has a tracr sequence shown in Table 3 below, or a tracr sequence at least 70%, 75%, 80%, 85%, 90%, 95%, 96%, 97%, 98%, or 99% identical to the tracr sequence shown below (SEQ: SEQ ID NO).

TABLE 3

Exemplary TRACR Sequences

| SEQ | Sequence (5' to 3') |
|---|---|
| 1087 | GUUUAAGAGCUAUGCUGGAAACAGCAUAGCAAGUUUAAAUAAGGCUAGUCCGUUAUCAACUUGAAAAAGUGGCACCGAGUCGGUGCUUUUUUU |
| 1088 | GUUUAGAGCUAGAAAUAGCAAGUUAAAAUAAGGCUAGUCCGUUAUCAACUUGAAAAAGUGGCACCGAGUCGGUGCUUUU |
| 1089 | GUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 1090 | GUUUAAGAGCUAAGCUGGAAACAGCAUAGCAAGUUUAAAUAAGGCUAGUCCGUUAUCAACUUGAAAAAGUGGCACCGAGUCGGUGCUUUUUUU |

In some embodiments, the gRNA herein is provided to the cell directly (e.g., through an RNP complex together with the CRISPR-associated protein domain). In some embodiments, the gRNA is provided to the cell through an expression vector (e.g., a plasmid vector or a viral vector) introduced into the cell, where the cell then expresses the gRNA from the expression vector. Methods of introducing gRNAs and expression vectors into cells are well known in the art.

III. Effector Domains

Epigenetic editors described herein include one or more effector protein domains (also "epigenetic effector domains," or "effector domains," as used herein) that effect epigenetic modification of a target gene. An epigenetic editor with one or more effector domains may modulate expression of a target gene without altering its nucleobase sequence. In some embodiments, an effector domain described herein may provide repression or silencing of expression of HBV or an HBV gene, e.g., by repressing transcription or by modifying or remodeling HBV chromatin. Such effector domains are also referred to herein as "repression domains," "repressor domains," "epigenetic repressor domains," or "epigenetic repression domains." Non-limiting examples of chemical modifications that may be mediated by effector domains include methylation, demethylation, acetylation, deacetylation, phosphorylation, SUMOylation and/or ubiquitination of DNA or histone residues.

In some embodiments, an effector domain of an epigenetic editor described herein may make histone tail modifications, e.g., by adding or removing active marks on histone tails.

In some embodiments, an effector domain of an epigenetic editor described herein may comprise or recruit a transcription-related protein, e.g., a transcription repressor. The transcription-related protein may be endogenous or exogenous.

In some embodiments, an effector domain of an epigenetic editor described herein may, for example, comprise a protein that directly or indirectly blocks access of a transcription factor to the gene of interest harboring the target sequence.

An effector domain may be a full-length protein or a fragment thereof that retains the epigenetic effector function (a "functional domain"). Functional domains that are capable of modulating (e.g., repressing) gene expression can be derived from a larger protein. For example, functional domains that can reduce target gene expression may be identified based on sequences of repressor proteins. Amino acid sequences of gene expression-modulating proteins may be obtained from available genome browsers, such as the UCSD genome browser or Ensembl genome browser. Protein annotation databases such as UniProt or Pfam can be used to identify functional domains within the full protein sequence. As a starting point, the largest sequence, encompassing all regions identified by different databases, may be tested for gene expression modulation activity. Various truncations then may be tested to identify the minimal functional unit.

Variants of effector domains described herein are also contemplated by the present disclosure. A variant may, for example, refer to a polypeptide with at least about 85%, 90%, 91%, 92%, 93%, 94%, 95%, 96%, 97%, 98%, 99%, or 100% sequence identity and/or sequence similarity to a wildtype effector domain described herein. In particular embodiments, the variant retains at least about 85%, 90%, 91%, 92%, 93%, 94%, 95%, 96%, 97%, 98%, 99%, or 100% of the epigenetic effector function of the wildtype effector domain.

In some embodiments, an epigenetic editor described herein may comprise 1 effector domain, 2 effector domains, 3 effector domains, 4 effector domains, 5 effector domains, 6 effector domains, 7 effector domains, 8 effector domains, 9 effector domains, 10 effector domains, or more. In certain embodiments, the epigenetic editor comprises one or more fusion proteins (e.g., one, two, or three fusion proteins), each with one or more effector domains (e.g., one, two, or three effector domains) linked to a DNA-binding domain. In some embodiments, the effector domains may induce a combination of epigenetic modifications, e.g., transcription repression and DNA methylation, DNA methylation and histone deacetylation, DNA methylation and histone demethylation, DNA methylation and histone methylation, DNA methylation and histone phosphorylation, DNA methylation and histone ubiquitylation, DNA methylation, and histone SUMOylation.

In certain embodiments, an effector domain described herein (e.g., DNMT3A and/or DNMT3L) is encoded by a nucleotide sequence as found in the native genome (e.g., human or murine) for that effector domain. In other embodiments, an effector domain described herein is encoded by a nucleotide sequence that has been codon-optimized for optimal expression in human cells.

Effector domains described herein may include, for example, transcriptional repressors, DNA methyltransferases, and/or histone modifiers, as further detailed below.

A. Transcriptional Repressors

In some embodiments, an epigenetic effector domain described herein mediates repression of a target gene's expression (e.g., transcription). The effector domain may comprise, e.g., a Krüppel-associated box (KRAB) repression domain, a Repressor Element Silencing Transcription Factor (REST) repression domain, a KRAB-associated protein 1 (KAP1) domain, a MAD domain, a FKHR (forkhead in rhabdosarcoma gene) repressor domain, an EGR-1 (early growth response gene product-1) repressor domain, an ets2 repressor factor repressor domain (ERD), a MAD smSIN3 interaction domain (SID), a WRPW motif (SEQ ID NO: 1257) of the hairy-related basic helix-loop-helix (bHLH) repressor proteins, an HP1 alpha chromo-shadow repression domain, an HP1 beta repression domain, or any combination thereof. The effector domain may recruit one or more protein domains that repress expression of the target gene, e.g., through a scaffold protein. In some embodiments, the effector domain may recruit or interact with a scaffold protein domain that recruits a PRMT protein, a HDAC protein, a SETDB1 protein, or a NuRD protein domain.

In some embodiments, the effector domain comprises a functional domain derived from a zinc finger repressor protein, such as a KRAB domain. KRAB domains are found in approximately 400 human ZFP-based transcription factors. Descriptions of KRAB domains may be found, for example, in Ecco et al., *Development* (2017) 144(15):2719-29 and Lambert et al., *Cell* (2018) 172:650-65.

In certain embodiments, the effector domain comprises a repression domain (e.g., KRAB) derived from KOX1/ZNF10, KOX8/ZNF708, ZNF43, ZNF184, ZNF91, HPF4, HTF10, or HTF34. In some embodiments, the effector domain comprises a repression domain (e.g., KRAB) derived from ZIM3, ZNF436, ZNF257, ZNF675, ZNF490, ZNF320, ZNF331, ZNF816, ZNF680, ZNF41, ZNF189, ZNF528, ZNF543, ZNF554, ZNF140, ZNF610, ZNF264, ZNF350, ZNF8, ZNF582, ZNF30, ZNF324, ZNF98, ZNF669, ZNF677, ZNF596, ZNF214, ZNF37, ZNF34, ZNF250, ZNF547, ZNF273, ZNF354, ZFP82, ZNF224, ZNF33, ZNF45, ZNF175, ZNF595, ZNF184, ZNF419, ZFP28-1, ZFP28-2, ZNF18, ZNF213, ZNF394, ZFP1, ZFP14, ZNF416, ZNF557, ZNF566, ZNF729, ZIM2, ZNF254, ZNF764, ZNF785, or any combination thereof. For example, the repression domain may be a KRAB domain derived from KOX1, ZIM3, ZFP28, or ZN627. In particular embodiments, the repression domain is a ZIM3 KRAB domain. In further embodiments, the effector domain is derived from a human protein, e.g., a human ZIM3, a human KOX1, a human ZFP28, or a human ZN627.

Exemplary effector domains that may reduce or silence target gene expression are provided in Table 4 below (SEQ: SEQ ID NO, see Table 18 for sequences of exemplary effector domains). Further examples of repressors and transcriptional repressor domains can be found, e.g., in PCT Patent Publication WO 2021/226077 and Tycko et al., *Cell* (2020) 183(7):2020-35, each of which is incorporated herein by reference in its entirety.

TABLE 4

Exemplary Effector Domains Suitable for Silencing Gene Expression

| Protein | SEQ |
|---|---|
| ZIM3 | 495 |
| ZNF436 | 496 |
| ZNF257 | 497 |
| ZNF675 | 498 |
| ZNF490 | 499 |
| ZNF320 | 500 |
| ZNF331 | 501 |
| ZNF816 | 502 |
| ZNF680 | 503 |
| ZNF41 | 504 |
| ZNF189 | 505 |
| ZNF528 | 506 |
| ZNF543 | 507 |
| ZNF554 | 508 |
| ZNF140 | 509 |
| ZNF610 | 510 |
| ZNF264 | 511 |
| ZNF350 | 512 |
| ZNF8 | 513 |
| ZNF582 | 514 |
| ZNF30 | 515 |
| ZNF324 | 516 |
| ZNF98 | 517 |
| ZNF669 | 518 |
| ZNF677 | 519 |

TABLE 4-continued

Exemplary Effector Domains Suitable for Silencing Gene Expression

| Protein | SEQ |
|---|---|
| ZNF596 | 520 |
| ZNF214 | 521 |
| ZNF37A | 522 |
| ZNF34 | 523 |
| ZNF250 | 524 |
| ZNF547 | 525 |
| ZNF273 | 526 |
| ZNF354A | 527 |
| ZFP82 | 528 |
| ZNF224 | 529 |
| ZNF33A | 530 |
| ZNF45 | 531 |
| ZNF175 | 532 |
| ZNF595 | 533 |
| ZNF184 | 534 |
| ZNF419 | 535 |
| ZFP28-1 | 536 |
| ZFP28-2 | 537 |
| ZNF18 | 538 |
| ZNF213 | 539 |
| ZNF394 | 540 |
| ZFP1 | 541 |
| ZFP14 | 542 |
| ZNF416 | 543 |
| ZNF557 | 544 |
| ZNF566 | 545 |
| ZNF729 | 546 |
| ZIM2 | 547 |
| ZNF254 | 548 |
| ZNF764 | 549 |
| ZNF785 | 550 |
| ZNF10 (KOX1) | 551 |
| CBX5 (chromoshadow domain) | 552 |
| RYBP (YAF2_RYBP component of PRC1) | 553 |
| YAF2 (YAF2_RYBP component of PRC1) | 554 |
| MGA (component of PRC1.6) | 555 |
| CBX1 (chromoshadow) | 556 |
| SCMHI (SAM_1/SPM) | 557 |
| MPP8 (Chromodomain) | 558 |
| SUMO3 (Rad60-SLD) | 559 |
| HERC2 (Cyt-b5) | 560 |
| BIN1 (SH3_9) | 561 |
| PCGF2 (RING finger protein domain) | 562 |
| TOX (HMG box) | 563 |
| FOXA1 (HNF3A C-terminal domain) | 564 |
| FOXA2 (HNF3B C-terminal domain) | 565 |
| IRF2BP1 (IRF-2BP1_2 N-terminal domain) | 566 |
| IRF2BP2 (IRF-2BP1_2 N-terminal domain) | 567 |
| IRF2BPL IRF-2BP1_2 N-terminal domain | 568 |
| HOXA13 (homeodomain) | 569 |
| HOXB13 (homeodomain) | 570 |
| HOXC13 (homeodomain) | 571 |
| HOXA11 (homeodomain) | 572 |
| HOXC11 (homeodomain) | 573 |
| HOXC10 (homeodomain) | 574 |
| HOXA10 (homeodomain) | 575 |
| HOXB9 (homeodomain) | 576 |
| HOXA9 (homeodomain) | 577 |
| ZFP28_HUMAN | 578 |
| ZN334_HUMAN | 579 |
| ZN568_HUMAN | 580 |
| ZN37A_HUMAN | 581 |
| ZN181_HUMAN | 582 |
| ZN510_HUMAN | 583 |
| ZN862_HUMAN | 584 |
| ZN140_HUMAN | 585 |

TABLE 4-continued

Exemplary Effector Domains Suitable for Silencing Gene Expression

| Protein | SEQ |
|---|---|
| ZN208_HUMAN | 586 |
| ZN248_HUMAN | 587 |
| ZN571_HUMAN | 588 |
| ZN699_HUMAN | 589 |
| ZN726_HUMAN | 590 |
| ZIK1_HUMAN | 591 |
| ZNF2_HUMAN | 592 |
| Z705F_HUMAN | 593 |
| ZNF14_HUMAN | 594 |
| ZN471_HUMAN | 595 |
| ZN624_HUMAN | 596 |
| ZNF84_HUMAN | 597 |
| ZNF7_HUMAN | 598 |
| ZN891_HUMAN | 599 |
| ZN337_HUMAN | 600 |
| Z705G_HUMAN | 601 |
| ZN529_HUMAN | 602 |
| ZN729_HUMAN | 603 |
| ZN419_HUMAN | 604 |
| Z705A_HUMAN | 605 |
| ZNF45_HUMAN | 606 |
| ZN302_HUMAN | 607 |
| ZN486_HUMAN | 608 |
| ZN621_HUMAN | 609 |
| ZN688_HUMAN | 610 |
| ZN33A_HUMAN | 611 |
| ZN554_HUMAN | 612 |
| ZN878_HUMAN | 613 |
| ZN772_HUMAN | 614 |
| ZN224_HUMAN | 615 |
| ZN184_HUMAN | 616 |
| ZN544_HUMAN | 617 |
| ZNF57_HUMAN | 618 |
| ZN283_HUMAN | 619 |
| ZN549_HUMAN | 620 |
| ZN211_HUMAN | 621 |
| ZN615_HUMAN | 622 |
| ZN253_HUMAN | 623 |
| ZN226_HUMAN | 624 |
| ZN730_HUMAN | 625 |
| Z585A_HUMAN | 626 |
| ZN732_HUMAN | 627 |
| ZN681_HUMAN | 628 |
| ZN667_HUMAN | 629 |
| ZN649_HUMAN | 630 |
| ZN470_HUMAN | 631 |
| ZN484_HUMAN | 632 |
| ZN431_HUMAN | 633 |
| ZN382_HUMAN | 634 |
| ZN254_HUMAN | 635 |
| ZN124_HUMAN | 636 |
| ZN607_HUMAN | 637 |
| ZN317_HUMAN | 638 |
| ZN620_HUMAN | 639 |
| ZN141_HUMAN | 640 |
| ZN584_HUMAN | 641 |
| ZN540_HUMAN | 642 |
| ZN75D_HUMAN | 643 |
| ZN555_HUMAN | 644 |
| ZN658_HUMAN | 645 |
| ZN684_HUMAN | 646 |
| RBAK_HUMAN | 647 |
| ZN829_HUMAN | 648 |
| ZN582_HUMAN | 649 |
| ZN112_HUMAN | 650 |
| ZN716_HUMAN | 651 |
| HKR1_HUMAN | 652 |
| ZN350_HUMAN | 653 |
| ZN480_HUMAN | 654 |
| ZN416_HUMAN | 655 |
| ZNF92_HUMAN | 656 |
| ZN100_HUMAN | 657 |
| ZN736_HUMAN | 658 |
| ZNF74_HUMAN | 659 |
| CBX1_HUMAN | 660 |
| ZN443_HUMAN | 661 |
| ZN195_HUMAN | 662 |
| ZN530_HUMAN | 663 |
| ZN782_HUMAN | 664 |
| ZN791_HUMAN | 665 |
| ZN331_HUMAN | 666 |
| Z354C_HUMAN | 667 |
| ZN157_HUMAN | |
| ZN727_HUMAN | 669 |
| ZN550_HUMAN | 670 |
| ZN793_HUMAN | 671 |
| ZN235_HUMAN | 672 |
| ZNF8_HUMAN | 673 |
| ZN724_HUMAN | 674 |
| ZN573_HUMAN | 675 |
| ZN577_HUMAN | 676 |
| ZN789_HUMAN | 677 |
| ZN718_HUMAN | 678 |
| ZN300_HUMAN | 679 |
| ZN383_HUMAN | 680 |
| ZN429_HUMAN | 681 |
| ZN677_HUMAN | 682 |
| ZN850_HUMAN | 683 |
| ZN454_HUMAN | 684 |
| ZN257_HUMAN | 685 |
| ZN264_HUMAN | 686 |
| ZFP82_HUMAN | 687 |
| ZFP14_HUMAN | 688 |
| ZN485_HUMAN | 689 |
| ZN737_HUMAN | 690 |
| ZNF44_HUMAN | 691 |
| ZN596_HUMAN | 692 |
| ZN565_HUMAN | 693 |
| ZN543_HUMAN | 694 |
| ZFP69_HUMAN | 695 |
| SUMO1_HUMAN | 696 |
| ZNF12_HUMAN | 697 |
| ZN169_HUMAN | 698 |
| ZN433_HUMAN | 699 |
| SUMO3_HUMAN | 700 |
| ZNF98_HUMAN | 701 |
| ZN175_HUMAN | 702 |
| ZN347_HUMAN | 703 |
| ZNF25_HUMAN | 704 |
| ZN519_HUMAN | 705 |
| Z585B_HUMAN | 706 |
| ZIM3_HUMAN | 707 |
| ZN517_HUMAN | 708 |
| ZN846_HUMAN | 709 |
| ZN230_HUMAN | 710 |
| ZNF66_HUMAN | 711 |
| ZFP1_HUMAN | 712 |
| ZN713_HUMAN | 713 |
| ZN816_HUMAN | 714 |
| ZN426_HUMAN | 715 |
| ZN674_HUMAN | 716 |
| ZN627_HUMAN | 717 |
| ZNF20_HUMAN | 718 |
| Z587B_HUMAN | 719 |
| ZN316_HUMAN | 720 |
| ZN233_HUMAN | 721 |
| ZN611_HUMAN | 722 |
| ZN556_HUMAN | 723 |
| ZN234_HUMAN | 724 |
| ZN560_HUMAN | 725 |
| ZNF77_HUMAN | 726 |
| ZN682_HUMAN | 727 |
| ZN614_HUMAN | 728 |
| ZN785_HUMAN | 729 |
| ZN445_HUMAN | 730 |
| ZFP30_HUMAN | 731 |
| ZN225_HUMAN | 732 |
| ZN551_HUMAN | 733 |

TABLE 4-continued

Exemplary Effector Domains Suitable for Silencing Gene Expression

| Protein | SEQ |
|---|---|
| ZN610_HUMAN | 734 |
| ZN528_HUMAN | 735 |
| ZN284_HUMAN | 736 |
| ZN418_HUMAN | 737 |
| MPP8_HUMAN | 738 |
| ZN490_HUMAN | 739 |
| ZN805_HUMAN | 740 |
| Z780B_HUMAN | 741 |
| ZN763_HUMAN | 742 |
| ZN285_HUMAN | 743 |
| ZNF85_HUMAN | 744 |
| ZN223_HUMAN | 745 |
| ZNF90_HUMAN | 746 |
| ZN557_HUMAN | 747 |
| ZN425_HUMAN | 748 |
| ZN229_HUMAN | 749 |
| ZN606_HUMAN | 750 |
| ZN155_HUMAN | 751 |
| ZN222_HUMAN | 752 |
| ZN442_HUMAN | 753 |
| ZNF91_HUMAN | 754 |
| ZN135_HUMAN | 755 |
| ZN778_HUMAN | 756 |
| RYBP_HUMAN | 757 |
| ZN534_HUMAN | 758 |
| ZN586_HUMAN | 759 |
| ZN567_HUMAN | 760 |
| ZN440_HUMAN | 761 |
| ZN583_HUMAN | 762 |
| ZN441_HUMAN | 763 |
| ZNF43_HUMAN | 764 |
| CBX5_HUMAN | 765 |
| ZN589_HUMAN | 766 |
| ZNF10_HUMAN | 767 |
| ZN563_HUMAN | 768 |
| ZN561_HUMAN | 769 |
| ZN136_HUMAN | 770 |
| ZN630_HUMAN | 771 |
| ZN527_HUMAN | 772 |
| ZN333_HUMAN | 773 |
| Z324B_HUMAN | 774 |
| ZN786_HUMAN | 775 |
| ZN709_HUMAN | 776 |
| ZN792_HUMAN | 777 |
| ZN599_HUMAN | 778 |
| ZN613_HUMAN | 779 |
| ZF69B_HUMAN | 780 |
| ZN799_HUMAN | 781 |
| ZN569_HUMAN | 782 |
| ZN564_HUMAN | 783 |
| ZN546_HUMAN | 784 |
| ZFP92_HUMAN | 785 |
| YAF2_HUMAN | 786 |
| ZN723_HUMAN | 787 |
| ZNF34_HUMAN | 788 |
| ZN439_HUMAN | 789 |
| ZFP57_HUMAN | 790 |
| ZNF19_HUMAN | 791 |
| ZN404_HUMAN | 792 |
| ZN274_HUMAN | 793 |
| CBX3_HUMAN | 794 |
| ZNF30_HUMAN | 795 |
| ZN250_HUMAN | 796 |
| ZN570_HUMAN | 797 |
| ZN675_HUMAN | 798 |
| ZN695_HUMAN | 799 |
| ZN548_HUMAN | 800 |
| ZN132_HUMAN | 801 |
| ZN738_HUMAN | 802 |
| ZN420_HUMAN | 803 |
| ZN626_HUMAN | 804 |
| ZN559_HUMAN | 805 |
| ZN460_HUMAN | 806 |
| ZN268_HUMAN | 807 |
| ZN304_HUMAN | 808 |
| ZIM2_HUMAN | 809 |
| ZN605_HUMAN | 810 |
| ZN844_HUMAN | 811 |
| SUMO5_HUMAN | 812 |
| ZN101_HUMAN | 813 |
| ZN783_HUMAN | 814 |
| ZN417_HUMAN | 815 |
| ZN182_HUMAN | 816 |
| ZN823_HUMAN | 817 |
| ZN177_HUMAN | 818 |
| ZN197_HUMAN | 819 |
| ZN717_HUMAN | 820 |
| ZN669_HUMAN | 821 |
| ZN256_HUMAN | 822 |
| ZN251_HUMAN | 823 |
| CBX4_HUMAN | 824 |
| PCGF2_HUMAN | 825 |
| CDY2_HUMAN | 826 |
| CDYL2_HUMAN | 827 |
| HERC2_HUMAN | 828 |
| ZN562_HUMAN | 829 |
| ZN461_HUMAN | 830 |
| Z324A_HUMAN | 831 |
| ZN766_HUMAN | 832 |
| ID2_HUMAN | 833 |
| TOX_HUMAN | 834 |
| ZN274_HUMAN | 835 |
| SCMH1_HUMAN | 836 |
| ZN214_HUMAN | 837 |
| CBX7_HUMAN | 838 |
| ID1_HUMAN | 839 |
| CREM_HUMAN | 840 |
| SCX_HUMAN | 841 |
| ASCL1_HUMAN | 842 |
| ZN764_HUMAN | 843 |
| SCML2_HUMAN | 844 |
| TWST1_HUMAN | 845 |
| CREB1_HUMAN | 846 |
| TERF1_HUMAN | 847 |
| ID3_HUMAN | 848 |
| CBX8_HUMAN | 849 |
| CBX4_HUMAN | 850 |
| GSX1_HUMAN | 851 |
| NKX22_HUMAN | 852 |
| ATF1_HUMAN | 853 |
| TWST2_HUMAN | 854 |
| ZNF17_HUMAN | 855 |
| TOX3_HUMAN | 856 |
| TOX4_HUMAN | 857 |
| ZMYM3_HUMAN | 858 |
| I2BP1_HUMAN | 859 |
| RHXF1_HUMAN | 860 |
| SSX2_HUMAN | 861 |
| I2BPL_HUMAN | 862 |
| ZN680_HUMAN | 863 |
| CBX1_HUMAN | 864 |
| TRI68_HUMAN | 865 |
| HXA13_HUMAN | 866 |
| PHC3_HUMAN | 867 |
| TCF24_HUMAN | 868 |
| CBX3_HUMAN | 869 |
| HXB13_HUMAN | 870 |
| HEY1_HUMAN | 871 |
| PHC2_HUMAN | 872 |
| ZNF81_HUMAN | 873 |
| FIGLA_HUMAN | 874 |
| SAM11_HUMAN | 875 |
| KMT2B_HUMAN | 876 |
| HEY2_HUMAN | 877 |
| JDP2_HUMAN | 878 |
| HXC13_HUMAN | 879 |
| ASCL4_HUMAN | 880 |
| HHEX_HUMAN | 881 |

TABLE 4-continued

Exemplary Effector Domains Suitable for Silencing Gene Expression

| Protein | SEQ |
|---|---|
| HERC2_HUMAN | 882 |
| GSX2_HUMAN | 883 |
| BIN1_HUMAN | 884 |
| ETV7_HUMAN | 885 |
| ASCL3_HUMAN | 886 |
| PHC1_HUMAN | 887 |
| OTP_HUMAN | 888 |
| I2BP2_HUMAN | 889 |
| VGLL2_HUMAN | 890 |
| HXA11_HUMAN | 891 |
| PDLI4_HUMAN | 892 |
| ASCL2_HUMAN | 893 |
| CDX4_HUMAN | 894 |
| ZN860_HUMAN | 895 |
| LMBL4_HUMAN | 896 |
| PDIP3_HUMAN | 897 |
| NKX25_HUMAN | 898 |
| CEBPB_HUMAN | 899 |
| ISL1_HUMAN | 900 |
| CDX2_HUMAN | 901 |
| PROP1_HUMAN | 902 |
| SIN3B_HUMAN | 903 |
| SMBT1_HUMAN | 904 |
| HXC11_HUMAN | 905 |
| HXC10_HUMAN | 906 |
| PRS6A_HUMAN | 907 |
| VSX1_HUMAN | 908 |
| NKX23_HUMAN | 909 |
| MTG16_HUMAN | 910 |
| HMX3_HUMAN | 911 |
| HMX1_HUMAN | 912 |
| KIF22_HUMAN | 913 |
| CSTF2_HUMAN | 914 |
| CEBPE_HUMAN | 915 |
| DLX2_HUMAN | 916 |
| ZMYM3_HUMAN | 917 |
| PPARG_HUMAN | 918 |
| PRIC1_HUMAN | 919 |
| UNC4_HUMAN | 920 |
| BARX2_HUMAN | 921 |
| ALX3_HUMAN | 922 |
| TCF15_HUMAN | 923 |
| TERA_HUMAN | 924 |
| VSX2_HUMAN | 925 |
| HXD12_HUMAN | 926 |
| CDX1_HUMAN | 927 |
| TCF23_HUMAN | 928 |
| ALX1_HUMAN | 929 |
| HXA10_HUMAN | 930 |
| RX_HUMAN | 931 |
| CXXC5_HUMAN | 932 |
| SCML1_HUMAN | 933 |
| NFIL3_HUMAN | 934 |
| DLX6_HUMAN | 935 |
| MTG8_HUMAN | 936 |
| CBX8_HUMAN | 937 |
| CEBPD_HUMAN | 938 |
| SEC13_HUMAN | 939 |
| FIP1_HUMAN | 940 |
| ALX4_HUMAN | 941 |
| LHX3_HUMAN | 942 |
| PRIC2_HUMAN | 943 |
| MAGI3_HUMAN | 944 |
| NELL1_HUMAN | 945 |
| PRRX1_HUMAN | 946 |
| MTG8R_HUMAN | 947 |
| RAX2_HUMAN | 948 |
| DLX3_HUMAN | 949 |
| DLX1_HUMAN | 950 |
| NKX26_HUMAN | 951 |
| NAB1_HUMAN | 952 |
| SAMD7_HUMAN | 953 |
| PITX3_HUMAN | 954 |
| WDR5_HUMAN | 955 |
| MEOX2_HUMAN | 956 |
| NAB2_HUMAN | 957 |
| DHX8_HUMAN | 958 |
| FOXA2_HUMAN | 959 |
| CBX6_HUMAN | 960 |
| EMX2_HUMAN | 961 |
| CPSF6_HUMAN | 962 |
| HXC12_HUMAN | 963 |
| KDM4B_HUMAN | 964 |
| LMBL3_HUMAN | 965 |
| PHX2A_HUMAN | 966 |
| EMX1_HUMAN | 967 |
| NC2B_HUMAN | 968 |
| DLX4_HUMAN | 969 |
| SRY_HUMAN | 970 |
| ZN777_HUMAN | 971 |
| NELL1_HUMAN | 972 |
| ZN398_HUMAN | 973 |
| GATA3_HUMAN | 974 |
| BSH_HUMAN | 975 |
| SF3B4_HUMAN | 976 |
| TEAD1_HUMAN | 977 |
| TEAD3_HUMAN | 978 |
| RGAP1_HUMAN | 979 |
| PHF1_HUMAN | 980 |
| FOXA1_HUMAN | 981 |
| GATA2_HUMAN | 982 |
| FOXO3_HUMAN | 983 |
| ZN212_HUMAN | 984 |
| IRX4_HUMAN | 985 |
| ZBED6_HUMAN | 986 |
| LHX4_HUMAN | 987 |
| SIN3A_HUMAN | 988 |
| RBBP7_HUMAN | 989 |
| NKX61_HUMAN | 990 |
| TRI68_HUMAN | 991 |
| R51A1_HUMAN | 992 |
| MB3L1_HUMAN | 993 |
| DLX5_HUMAN | 994 |
| NOTC1_HUMAN | 995 |
| TERF2_HUMAN | 996 |
| ZN282_HUMAN | 997 |
| RGS12_HUMAN | 998 |
| ZN840_HUMAN | 999 |
| SPI2B_HUMAN | 1000 |
| PAX7_HUMAN | 1001 |
| NKX62_HUMAN | 1002 |
| ASXL2_HUMAN | 1003 |
| FOXO1_HUMAN | 1004 |
| GATA3_HUMAN | 1005 |
| GATA1_HUMAN | 1006 |
| ZMYM5_HUMAN | 1007 |
| ZN783_HUMAN | 1008 |
| SPI2B_HUMAN | 1009 |
| LRP1_HUMAN | 1010 |
| MIXL1_HUMAN | 1011 |
| SGT1_HUMAN | 1012 |
| LMCD1_HUMAN | 1013 |
| CEBPA_HUMAN | 1014 |
| GATA2_HUMAN | 1015 |
| SOX14_HUMAN | 1016 |
| WTIP_HUMAN | 1017 |
| PRP19_HUMAN | 1018 |
| CBX6_HUMAN | 1019 |
| NKX11_HUMAN | 1020 |
| RBBP4_HUMAN | 1021 |
| DMRT2_HUMAN | 1022 |
| SMCA2_HUMAN | 1023 |
| ZNF10_HUMAN | 1024 |
| EED_HUMAN | 1025 |
| RCOR1_HUMAN | 1026 |

A functional analog of any one of the above-listed proteins, i.e., a molecule having the same or substantially the same biological function (e.g., retaining 70% or more, 80% or more, 90% or more, 95% or more, or 98% or more) of the protein's transcription factor function) is encompassed by the present disclosure. For example, the functional analog may be an isoform or a variant of the above-listed protein, e.g., containing a portion of the above protein with or without additional amino acid residues and/or containing mutations relative to the above protein. In some embodiments, the functional analog has a sequence identity that is at least 75, 80, 85, 90, 95, 98, or 99% to one of the sequences listed in Table 4. Homologs, orthologs, and mutants of the above-listed proteins are also contemplated.

In certain embodiments, an epigenetic editor described herein comprises a KRAB domain derived from KOX1, ZIM3, ZFP28, or ZN627, and/or an effector domain derived from KAP1, MECP2, HP1a, HP1b, CBX8, CDYL2, TOX, TOX3, TOX4, EED, EZH2, RBBP4, RCOR1, or SCML2, optionally wherein the parental protein is a human protein. In particular embodiments, an epigenetic editor described herein comprises a domain derived from KOX1, ZIM3, ZFP28, and/or ZN627, optionally wherein the parental protein is a human protein. In certain embodiments, the epigenetic editor may comprise a KRAB domain derived from KOX1 (ZNF10), e.g., a human KOX1. In certain embodiments, the epigenetic editor may comprise a KRAB domain derived from ZIM3 (ZNF657 or ZNF264), e.g., a human ZIM3. In certain embodiments, the epigenetic editor may comprise a KRAB domain derived from ZFP28, e.g., a human ZFP28. In certain embodiments, the epigenetic editor may comprise a KRAB domain derived from ZN627, e.g., a human ZN627. In certain embodiments, an epigenetic editor described herein may comprise a CDYL2, e.g., a human CDYL2, and/or a TOX domain (e.g., a human TOX domain) in combination with a KOX1 KRAB domain (e.g., a human KOX1 KRAB domain).

In certain embodiments, an epigenetic effector described herein comprises a repression domain derived from ZNF10 (SEQ ID NO: 1024). For example, the repression domain may comprise the sequence of SEQ ID NO: 1024, or a sequence at least 75%, 80%, 85%, 90%, 91%, 92%, 93%, 94%, 95%, 96%, 97%, 98%, or 99% identical to SEQ ID NO: 1024.

B. DNA Methyltransferases

In some embodiments, an effector domain of an epigenetic editor described herein alters target gene expression through DNA modification, such as methylation. Highly methylated areas of DNA tend to be less transcriptionally active than less methylated areas. DNA methylation occurs primarily at CpG sites (shorthand for "C-phosphate-G-" or "cytosine-phosphate-guanine" sites). Many mammalian genes have promoter regions near or including CpG islands (nucleic acid regions with a high frequency of CpG dinucleotides).

An effector domain described herein may be, e.g., a DNA methyltransferase (DNMT) or a catalytic domain thereof, or may be capable of recruiting a DNA methyltransferase. DNMTs encompass enzymes that catalyze the transfer of a methyl group to a DNA nucleotide, such as canonical cytosine-5 DNMTs that catalyze the addition of methyl groups to genomic DNA (e.g., DNMT1, DNMT3A, DNMT3B, and DNMT3C). This term also encompasses non-canonical family members that do not catalyze methylation themselves but that recruit (including activate) catalytically active DNMTs; a non-limiting example of such a DNMT is DNMT3L. See, e.g., Lyko, *Nat Review* (2018) 19:81-92. Unless otherwise indicated, a DNMT domain may refer to a polypeptide domain derived from a catalytically active DNMT (e.g., DNMT1, DNMT3A, and DNMT3B) or from a catalytically inactive DNMT (e.g., DNMT3L). A DNMT may repress expression of the target gene through the recruitment of repressive regulatory proteins. In some embodiments, the methylation is at a CG (or CpG) dinucleotide sequence. In some embodiments, the methylation is at a CHG or CHH sequence, where H is any one of A, T, or C. In some embodiments, DNMTs in the epigenetic editors may include, e.g., DNMT1, DNMT3A, DNMT3B, and/or DNMT3C. In some embodiments, the DNMT is a mammalian (e.g., human or murine) DNMT. In particular embodiments, the DNMT is DNMT3A (e.g., human DNMT3A). In certain embodiments, an epigenetic editor described herein comprises a DNMT3A domain comprising SEQ ID NO: 1028, or a sequence at least 75%, 80%, 85%, 90%, 91%, 92%, 93%, 94%, 95%, 96%, 97%, 98%, or 99% identical to SEQ ID NO: 1028. In certain embodiments, an epigenetic editor described herein comprises a DNMT3A domain comprising SEQ ID NO: 1029, or a sequence at least 75%, 80%, 85%, 90%, 91%, 92%, 93%, 94%, 95%, 96%, 97%, 98%, or 99% identical to SEQ ID NO: 1029. In some embodiments, the DNMT3A domain may have, e.g., a mutation at position H739 (such as H739A or H739E), R771 (such as R771L) and/or R836 (such as R836A or R836Q), or any combination thereof (numbering according to SEQ ID NO: 1028).

In some embodiments, an effector domain described herein may be a DNMT-like domain. As used herein a "DNMT-like domain" is a regulatory factor of DNA methyltransferase that may activate or recruit other DNMT domains, but does not itself possess methylation activity. In some embodiments, the DNMT-like domain is a mammalian (e.g., human or mouse) DNMT-like domain. In certain embodiments, the DNMT-like domain is DNMT3L, which may be, for example, human DNMT3L or mouse DNMT3L. In certain embodiments, an epigenetic editor described herein comprises a DNMT3L domain comprising SEQ ID NO: 1032, or a sequence at least 75%, 80%, 85%, 90%, 91%, 92%, 93%, 94%, 95%, 96%, 97%, 98%, or 99% identical to SEQ ID NO: 1032. In certain embodiments, an epigenetic editor herein comprises a DNMT3L domain comprising SEQ ID NO: 1033, or a sequence at least 75%, 80%, 85%, 90%, 91%, 92%, 93%, 94%, 95%, 96%, 97%, 98%, or 99% identical to SEQ ID NO: 1033. In certain embodiments, an epigenetic editor described herein comprises a DNMT3L domain comprising SEQ ID NO: 1034, or a sequence at least 75%, 80%, 85%, 90%, 91%, 92%, 93%, 94%, 95%, 96%, 97%, 98%, or 99% identical to SEQ ID NO: 1034. In certain embodiments, an epigenetic editor described herein comprises a DNMT3L domain comprising SEQ ID NO: 1035, or a sequence at least 75%, 80%, 85%, 90%, 91%, 92%, 93%, 94%, 95%, 96%, 97%, 98%, or 99% identical to SEQ ID NO: 1035. In some embodiments, the DNMT3L domain may have, e.g., a mutation corresponding to that at position D226 (such as D226V), Q268 (such as Q268K), or both (numbering according to SEQ ID NO: 1032).

In certain embodiments, an epigenetic editor herein may comprise comprising both DNMT and DNMT-like effector domains. For example, the epigenetic editor may comprise a DNMT3A-3L domain, wherein DNMT3A and DNMT3L may be covalently linked. In other embodiments, an epigenetic editor described herein may comprise an effector domain that comprises only a DNMT3A domain (e.g., human DNMT3A), or only a DNMT-like domain (e.g., DNMT3L, which may be human or mouse DNMT3L).

Table 5 below provides exemplary methyltransferases from which an effector domain of an epigenetic editor described herein may be derived. See Table 18 for sequences of these exemplary methyltransferases.

TABLE 5

Exemplary DNA Methyltransferase Sequences

| Protein Name | Species | Target | Protein Sequence |
|---|---|---|---|
| DNMT1 | Human | 5mC | SEQ ID NO: 1027 |
| DNMT3A | Human | 5mC | SEQ ID NO: 1028 |
| DNMT3A (catalytic domain) | Human | 5mC | SEQ ID NO: 1029 |
| DNMT3B | Human | 5mC | SEQ ID NO: 1030 |
| DNMT3C | Mouse | 5mC | SEQ ID NO: 1031 |
| DNMT3L | Human | 5mC | SEQ ID NO: 1032 |
| DNMT3L (catalytic domain) | Human | 5mC | SEQ ID NO: 1033 |
| DNMT3L | Mouse | 5mC | SEQ ID NO: 1034 |
| DNMT3L (catalytic domain) | Mouse | 5mC | SEQ ID NO: 1035 |
| TRDMT1 (DNMT2) | Human | tRNA 5mC | SEQ ID NO: 1036 |
| M.MpeI | Mycoplasma penetrans | 5mC | SEQ ID NO: 1037 |
| M.SssI | Spiroplasma monobiae | 5mC | SEQ ID NO: 1038 |
| M.HpaII | Haemophilus parainfluenzae | 5mC (CCGG) | SEQ ID NO: 1039 |
| M.AluI | Arthrobacter luteus | 5mC (AGCT) | SEQ ID NO: 1040 |
| M.HaeIII | Haemophilus aegyptius | 5mC (GGCC) | SEQ ID NO: 1041 |
| M.HhaI | Haemophilus haemolyticus | 5mC (GCGC) | SEQ ID NO: 1042 |
| M.MspI | Moraxella | 5mC (CCGG) | SEQ ID NO: 1043 |
| Masc1 | Ascobolus | 5mC | SEQ ID NO: 1044 |
| MET1 | Arabidopsis | 5mC | SEQ ID NO: 1045 |
| Masc2 | Ascobolus | 5mC | SEQ ID NO: 1046 |
| Dim-2 | Neurospora | 5mC | SEQ ID NO: 1047 |
| dDnmt2 | Drosophila | 5mC | SEQ ID NO: 1048 |
| Pmt1 | S. pombe | 5mC | SEQ ID NO: 1049 |
| DRM1 | Arabidopsis | 5mC | SEQ ID NO: 1050 |
| DRM2 | Arabidopsis | 5mC | SEQ ID NO: 1051 |
| CMT1 | Arabidopsis | 5mC | SEQ ID NO: 1052 |
| CMT2 | Arabidopsis | 5mC | SEQ ID NO: 1053 |
| CMT3 | Arabidopsis | 5mC | SEQ ID NO: 1054 |
| Rid | Neurospora | 5mC | SEQ ID NO: 1055 |
| hsdM gene | bacteria (E. coli, strain 12) | m6A | SEQ ID NO: 1056 |
| hsdS gene | bacteria (E. coli, strain 12) | m6A | SEQ ID NO: 1057 |
| M.TaqI | Bacteria (Thermus aquaticus) | m6A | SEQ ID NO: 1058 |
| M.EcoDam | E. coli | m6A | SEQ ID NO: 1059 |
| M.CcrMI | Caulobacter crescentus | m6A | SEQ ID NO: 1060 |
| CamA | Clostridioides difficile | m6A | SEQ ID NO: 1061 |

A functional analog of any one of the above-listed proteins, i.e., a molecule having the same or substantially the same biological function (e.g., retaining 70% or more, 80% or more, 90% or more, 95% or more, or 98% or more) of the protein's DNA methylation function or recruiting function) is encompassed by the present disclosure. For example, the functional analog may be an isoform or a variant of the above-listed protein, e.g., containing a portion of the above protein with or without additional amino acid residues and/or containing mutations relative to the above protein. In some embodiments, the functional analog has a sequence identity that is at least 75, 80, 85, 90, 95, 98, or 99% to one of the sequences listed in Table 5. In some embodiments, the effector domain herein comprises only the functional domain (or functional analog thereof), e.g., the catalytical domain or recruiting domain, of the above-listed proteins.

As used herein, a DNMT domain (e.g., a DNMT3A domain or a DNMT3L domain) refers to a protein domain that is identical to the parental protein (e.g., a human or murine DNMT3A or DNMT3L) or a functional analog thereof (e.g., having a functional fragment, such as a catalytic fragment or recruiting fragment, of the parental protein; and/or having mutations that improve the activity of the DNMT protein).

An epigenetic editor herein may effect methylation at, e.g., 1, 2, 3, 4, 5, 6, 7, 8, 9, 10, 11, 12, 13, 14, 15, 16, 17, 18, 19, 20, 30, 40, 50, 60, 70, 80, 90, 100, 200, 300, 400, 500, 600, 700, 800, 900, or 1000 or more CpG dinucleotide sequences in the target gene or chromosome. The CpG dinucleotide sequences may be located within or near the target gene in CpG islands, or may be located in a region that is not a CpG island. A CpG island generally refers to a nucleic acid sequence or chromosome region that comprises a high frequency of CpG dinucleotides. For example, a CpG island may comprise at least 50% GC content. The CpG island may have a high observed-to-expected CpG ratio, for example, an observed-to-expected CpG ratio of at least 60%. As used herein, an observed-to-expected CpG ratio is determined by Number of CpG*(sequence length)/(Number of C*Number of G). In some embodiments, the CpG island has an observed-to-expected CpG ratio of at least 60%, 70%, 80%, 90% or more. A CpG island may be a sequence or region of, e.g., at least 200, 250, 300, 350, 400, 450, 500, 550, 600, 650, 700, 750, or 800 nucleotides. In some embodiments, only 1, or less than 2, 3, 4, 5, 6, 7, 8, 9, 10, 11, 12, 13, 14, 15, 16, 17, 18, 19, 20, 30, 40, or 50 CpG dinucleotides are methylated by the epigenetic editor.

In some embodiments, an epigenetic editor herein effects methylation at a hypomethylated nucleic acid sequence, i.e., a sequence that may lack methyl groups on the 5-methyl cytosine nucleotides (e.g., in CpG) as compared to a standard control. Hypomethylation may occur, for example, in aging cells or in cancer (e.g., early stages of neoplasia) relative to a younger cell or non-cancer cell, respectively.

In some embodiments, an epigenetic editor described herein induces methylation at a hypermethylated nucleic acid sequence.

In some embodiments, methylation may be introduced by the epigenetic editor at a site other than a CpG dinucleotide. For example, the target gene sequence may be methylated at the C nucleotide of CpA, CpT, or CpC sequences. In some embodiments, an epigenetic editor comprises a DNMT3A domain and effects methylation at CpG, CpA, CpT, CpC sequences, or any combination thereof. In some embodiments, an epigenetic editor comprises a DNMT3A domain that lacks a regulatory subdomain and only maintains a catalytic domain. In some embodiments, the epigenetic editor comprising a DNMT3A catalytic domain effects methylation exclusively at CpG sequences. In some embodiments, an epigenetic editor comprising a DNMT3A domain that comprises a mutation, e.g. a R836A or R836Q mutation (numbering according to SEQ ID NO: 1028), has higher methylation activity at CpA, CpC, and/or CpT sequences as compared to an epigenetic editor comprising a wildtype DNMT3A domain.

C. Histone Modifiers

In some embodiments, an effector domain of an epigenetic editor herein mediates histone modification. Histone modifications play a structural and biochemical role in gene transcription, such as by formation or disruption of the nucleosome structure that binds to the histone and prevents gene transcription. Histone modifications may include, for example, acetylation, deacetylation, methylation, phosphorylation, ubiquitination, SUMOylation and the like, e.g., at their N-terminal ends ("histone tails"). These modifications maintain or specifically convert chromatin structure, thereby controlling responses such as gene expression, DNA replication, DNA repair, and the like, which occur on chromosomal DNA. Post-translational modification of histones is an epigenetic regulatory mechanism and is considered essential for the genetic regulation of eukaryotic cells. Recent studies have revealed that chromatin remodeling factors such as SWI/SNF, RSC, NURF, NRD, and the like, which facilitate transcription factor access to DNA by modifying the nucleosome structure; histone acetyltransferases (HATs) that regulate the acetylation state of histones; and histone deacetylases (HDACs), act as important regulators.

In particular, the unstructured N-termini of histones may be modified by acetylation, deacetylation, methylation, ubiquitylation, phosphorylation, SUMOylation, ribosylation, citrullination O-GlcNAcylation, crotonylation, or any combination thereof. For example, histone acetyltransferases (HATs) utilize acetyl-CoA as a cofactor and catalyze the transfer of an acetyl group to the epsilon amino group of the lysine side chains. This neutralizes the lysine's positive charge and weakens the interactions between histones and DNA, thus opening the chromosomes for transcription factors to bind and initiate transcription. Acetylation of K14 and K9 lysines of histone H3 by histone acetyltransferase enzymes may be linked to transcriptional competence in humans. Lysine acetylation may directly or indirectly create binding sites for chromatin-modifying enzymes that regulate transcriptional activation. On the other hand, histone methylation of lysine 9 of histone H3 may be associated with heterochromatin, or transcriptionally silent chromatin.

In certain embodiments, an effector domain of an epigenetic editor described herein comprises a histone methyltransferase domain. The effector domain may comprise, for example, a DOT1L domain, a SET domain, a SUV39H1 domain, a G9a/EHMT2 protein domain, an EZH1 domain, an EZH2 domain, a SETDB1 domain, or any combination thereof. In particular embodiments, the effector domain comprises a histone-lysine-N-methyltransferase SETDB1 domain.

In some embodiments, the effector domain comprises a histone deacetylase protein domain. In certain embodiments, the effector domain comprises a HDAC family protein domain, for example, a HDAC1, HDAC3, HDAC5, HDAC7, or HDAC9 protein domain. In particular embodiments, the effector domain comprises a nucleosome remodeling and deacetylase complex (NURD), which removes acetyl groups from histones.

D. Other Effector Domains

In some embodiments, the effector domain comprises a tripartite motif containing protein (TRIM28, TIF1-beta, or KAP1). In certain embodiments, the effector domain comprises one or more KAP1 proteins. A KAP1 protein in an epigenetic editor herein may form a complex with one or more other effector domains of the epigenetic editor or one or more proteins involved in modulation of gene expression in a cellular environment. For example, KAP1 may be recruited by a KRAB domain of a transcriptional repressor. A KAP1 protein domain may interact with or recruit one or more protein complexes that reduces or silences gene expression. In some embodiments, KAP1 interacts with or recruits a histone deacetylase protein, a histone-lysine methyltransferase protein, a chromatin remodeling protein, and/or a heterochromatin protein. For example, a KAP1 protein domain may interact with or recruit a heterochromatin protein 1 (HP1) protein, a SETDB1 protein, an HDAC protein, and/or a NuRD protein complex component. In some embodiments, a KAP1 protein domain interacts with or recruits a ZFP90 protein (e.g., isoform 2 of ZFP90), and/or a FOXP3 protein. An exemplary KAP1 amino acid sequence is shown in SEQ ID NO: 1062.

In some embodiments, the effector domain comprises a protein domain that interacts with or is recruited by one or more DNA epigenetic marks. For example, the effector domain may comprise a methyl CpG binding protein 2 (MECP2) protein that interacts with methylated DNA nucleotides in the target gene (which may or may not be at a CpG island of the target gene). An MECP2 protein domain in an epigenetic editor described herein may induce condensed chromatin structure, thereby reducing or silencing expression of the target gene. In some embodiments, an MECP2 protein domain in an epigenetic editor described herein may interact with a histone deacetylase (e.g. HDAC), thereby repressing or silencing expression of the target gene. In some embodiments, an MECP2 protein domain in an epigenetic editor described herein may block access of a transcription factor or transcriptional activator to the target sequence, thereby repressing or silencing expression of the target gene. An exemplary MECP2 amino acid sequence is shown in SEQ ID NO: 1063.

Also contemplated as effector domains for the epigenetic editors described herein are, e.g., a chromoshadow domain, a ubiquitin-2 like Rad60 SUMO-like (Rad60-SLD/SUMO) domain, a chromatin organization modifier domain (Chromo) domain, a Yaf2/RYBP C-terminal binding motif domain (YAF2_RYBP), a CBX family C-terminal motif domain (CBX7_C), a zinc finger C3HC4 type (RING finger) domain (ZF-C3HC4_2), a cytochrome b5 domain (Cyt-b5), a helix-loop-helix domain (HLH), a helix-hairpin-helix motif domain (e.g., HHH_3), a high mobility group box domain (HMG-box), a basic leucine zipper domain (e.g., bZIP_1 or bZIP_2), a Myb_DNA-binding domain, a homeodomain, a MYM-type Zinc finger with FCS sequence domain (ZF-FCS), an interferon regulatory factor 2-binding protein zinc finger domain (IRF-2BP1_2), an SSX repression domain (SSXRD), a B-box-type zinc finger domain (ZF-B_box), a CXXC zinc finger domain (ZF-CXXC), a regulator of chromosome condensation 1 domain (RCC1), an SRC homology 3 domain (SH3_9), a sterile alpha motif domain (SAM_1), a sterile alpha motif domain (SAM 2), a sterile alpha motif/Pointed domain (SAM_PNT), a Vestigial/Tondu family domain (Vg_Tdu), a LIM domain, an RNA recognition motif domain (RRM_1), a paired amphipathic helix domain (PAH), a proteasomal ATPase OB C-terminal domain (Prot_ATP_ID_OB), a nervy homology 2 domain (NHR2), a hinge domain of cleavage stimulation factor subunit 2 (CSTF2_hinge), a PPAR gamma N-terminal region domain (PPARgamma_N), a CDC48 N-terminal domain (CDC48_2), a WD40 repeat domain (WD40), a Fip1 motif domain (Fip1), a PDZ domain (PDZ_6), a Von Willebrand factor type C domain (VWC), a NAB conserved region 1 domain (NCD1), an S1 RNA-binding domain (S1), an HNF3C-terminal domain (HNF_C), a Tudor domain (Tudor_2), a histone-like transcription factor (CBF/NF-Y) and archaeal histone domain (CBFD_NFYB_HMF), a zinc finger protein domain (DUF3669), an EGF-like domain (cEGF), a GATA zinc finger domain (GATA), a TEA/ATTS domain (TEA), a phorbol esters/diacylglycerol binding domain (C1-1), polycomb-like MTF2 factor 2 domain (Mtf2_C), a transactivation domain of FOXO protein family (FOXO-TAD), a homeobox KN domain (Homeobox_KN), a BED zinc finger domain (ZF-BED), a zinc finger of C3HC4-type RING domain (ZF-C3HC4_4), a RAD51 interacting motif domain (RAD51_interact), a p55-binding region of a methyl-CpG-binding domain protein MBD (MBDa), a Notch domain, a Raf-like Ras-binding domain (RBD), a Spin/Ssty family domain (Spin-Ssty), a PHD finger domain (PHD_3), a Low-density lipoprotein receptor domain class A (Ldl_recept_a), a CS domain, a DM DNA-binding domain, and a QLQ domain.

In some embodiments, the effector domain is a protein domain comprising a YAF2_RYBP domain or homeodomain or any combination thereof. In certain embodiments, the homeodomain of the YAF2_RYBP domain is a PRD domain, an NKL domain, a HOXL domain, or a LIM domain. In particular embodiments, the YAF2_RYBP domain may comprise a 32 amino acid Yaf2/RYBP C-terminal binding motif domain (32 aa RYBP).

In some embodiments, the effector domain comprises a protein domain selected from a group consisting of SUMO3 domain, Chromo domain from M phase phosphoprotein 8 (MPP8), chromoshadow domain from Chromobox 1 (CBX1), and SAM_1/SPM domain from Scm Polycomb Group Protein Homolog 1 (SCMH1).

In some embodiments, the effector domain comprises an HNF3 C-terminal domain (HNF_C). The HNF_C domain may be from FOXA1 or FOXA2. In certain embodiments, the HNF_C domain comprises an EH1 (engrailed homology 1) motif.

In some embodiments, the effector domain may comprise an interferon regulatory factor 2-binding protein zinc finger domain (IRF-2BP1_2), a Cyt-b5 domain from DNA repair factor HERC2 E3 ligase, a variant SH3 domain (SH3_9) from Bridging Integrator 1 (BIN1), an HMG-box domain from transcription factor TOX or ZF-C3HC4-2 RING finger domain from the polycomb component PCGF2, a Chromodomain-helicase-DNA binding protein 3 (CHD3) domain, or a ZNF783 domain.

IV. Epigenetic Editors

Provided herein are epigenetic editors, also referred to herein as epigenetic editing systems, that direct epigenetic modification(s) to a target sequence in a gene of interest, e.g., using one or more DNA-binding domains as described herein and one or more effector domains (e.g., epigenetic repression domains) as described herein, in any combination. The DNA-binding domain (in concert with a guide polynucleotide such as one described herein, where the DNA-binding domain is a polynucleotide guided DNA-binding domain) directs the effector domain to epigenetically modify the target sequence, resulting in gene repression or silencing that may be durable and inheritable across cell generations. In some aspects, the epigenetic editors described herein can repress or silence genes reversibly or irreversibly in cells.

In particular embodiments, an epigenetic editor described herein comprises one or more fusion proteins, each comprising (1) DNA-binding domain(s) and (2) effector domain(s). The effector domains may be on one or more fusion proteins comprised by the epigenetic editor. For example, a single fusion protein may comprise all of the effector domains with a DNA-binding domain. Alternatively, the effector domains or subsets thereof may be on separate fusion proteins, each with a DNA-binding domain (which may be the same or different). A fusion protein described herein may further comprise one or more linkers (e.g., peptide linkers), detectable tags, nuclear localization signals (NLSs), or any combination thereof. As used herein, a "fusion protein" refers to a chimeric protein in which two or more coding sequences (e.g., for DNA-binding domain(s) and/or effector domain(s)) are covalently or non-covalently joined, directly or indirectly.

In some embodiments, an epigenetic editor described herein comprises 2, 3, 4, 5, 6, 7, 8, 9, 10, or more effector (e.g., repression) domains, which may be identical or different. In certain embodiments, two or more of said effector domains function synergistically. Combinations of effector domains may comprise DNA methylation domains, histone deacetylation domains, histone methylation domains, and/or scaffold domains that recruit any of the above. For example, an epigenetic editor described herein may comprise one or more transcriptional repressor domains (e.g., a KRAB domain such as KOX1, ZIM3, ZFP28, or ZN627 KRAB) in combination with one or more DNA methylation domains (e.g., a DNMT domain) and/or recruiter domain (e.g., a DNMT3L domain). Such an epigenetic editor may comprise, for instance, a KRAB domain, a DNMT3A domain, and a DNMT3L domain. An epigenetic editor can comprise a DNMT3A domain and a DNMT3L domain and preferably further comprise a KRAB domain. In some embodiments, the epigenetic editor further comprises an additional effector domain (e.g., a KAP1, MECP2, HP1b, CBX8, CDYL2, TOX, TOX3, TOX4, EED, RBBP4, RCOR1, or SCML2 domain). In some embodiments, the additional effector domain is a CDYL2, TOX, TOX3, TOX4, or HP1a domain.

For example, an epigenetic editor described herein may comprise a CDYL2 and/or a TOX domain in combination with a KRAB domain (e.g., a KOX1 KRAB domain).

A. Linkers

A fusion protein as described herein may comprise one or more linkers that connect components of the epigenetic editor. A linker may be a peptide or non-peptide linker.

In some embodiments, one or more linkers utilized in an epigenetic editor provided herein is a peptide linker, i.e., a linker comprising a peptide moiety. A peptide linker can be any length applicable to the epigenetic editor fusion proteins described herein. In some embodiments, the linker can comprise a peptide between 1 and 200 (e.g., between 1 and 80) amino acids. In some embodiments, the linker comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. Longer or shorter linkers are also contemplated. In some embodiments, the peptide linker is 3, 4, 5, 6, 7, 8, 9, 10, 11, 12, 13, 14, 15, 16, 17, 18, 19, 20, 25, 30, 25, 40, 45, 50, 55, 60, 65, 70, 75, 80, 85, 90, 95, or 100 amino acids in length. For example, the peptide linker may be 4, 5, 16, 20, 24, 27, 32, 40, 64, 92, or 104 amino acids in length. The peptide linker may be a flexible or rigid linker. In particular embodiments, the peptide linker comprises the amino acid sequence of any one of SEQ ID NOs: 1064-1068 or a sequence at least 75%, 80%, 85%, 90%, 91%, 92%, 93%, 94%, 95%, 96%, 97%, 98%, or 99% identical thereto.

In certain embodiments, the peptide linker is an XTEN linker. Such a linker may comprise part of the XTEN sequence (Schellenberger et al., *Nat Biotechnol* (2009) 27(1):1186-90), an unstructured hydrophilic polypeptide consisting only of residues G, S, P, T, E, and A. The term "XTEN" as used herein refers to a recombinant peptide or polypeptide lacking hydrophobic amino acid residues. XTEN linkers typically are unstructured and comprise a limited set of natural amino acids. Fusion of XTEN to proteins alters its hydrodynamic properties and reduces the rate of clearance and degradation of the fusion protein. These XTEN fusion proteins are produced using recombinant technology, without the need for chemical modifications, and degraded by natural pathways. The XTEN linker may be, for example, 5, 10, 16, 20, 26, or 80 amino acids in length. In some embodiments, the XTEN linker is 16 amino acids in length. In some embodiments, the XTEN linker is 80 amino acids in length. In certain embodiments, the XTEN linker may be XTEN10, XTEN16, XTEN20, or XTEN80. In certain embodiments, the XTEN linker may comprise the amino acid sequence of any one of SEQ ID NOs: 1069-1073 and 1092 or a sequence at least 75%, 80%, 85%, 90%, 91%, 92%, 93%, 94%, 95%, 96%, 97%, 98%, or 99% identical thereto. In some embodiments, the XTEN linker may be XTEN10, XTEN16, XTEN20, or XTEN80.

In some embodiments, one or more linkers utilized in an epigenetic editor provided herein is a non-peptide linker. For example, the linker may be a carbon bond, a disulfide bond, or carbon-heteroatom bond. In certain embodiments, the linker is a carbon-nitrogen bond of an amide linkage. In certain embodiments, the linker is a cyclic or acyclic, substituted or unsubstituted, or branched or unbranched aliphatic or heteroaliphatic linker.

In some embodiments, one or more linkers utilized in an epigenetic editor provided herein is polymeric (e.g., polyethylene, polyethylene glycol, polyamide, polyester, etc.). The linker may comprise, for example, a monomer, dimer, or polymer of aminoalkanoic acid; an aminoalkanoic acid (e.g., glycine, ethanoic acid, alanine, beta-alanine, 3-aminopropanoic acid, 4-aminobutanoic acid, 5-pentanoic acid, etc.); a monomer, dimer, or polymer of aminohexanoic acid (Ahx); or a polyethylene glycol moiety (PEG); or an aryl or heteroaryl moiety. In certain embodiments, the linker may be based on a carbocyclic moiety (e.g., cyclopentane or cyclohexane) or a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, alkyl halides, aryl halides, acyl halides, and isothiocyanates.

Various linker lengths and flexibilities can be employed between any two components of an epigenetic editor (e.g., between an effector domain (e.g., a repressor domain) and a DNA-binding domain (e.g., a Cas9 domain), between a first effector domain and a second effector domain, etc.). The linkers may range from very flexible linkers, such as glycine/serine-rich linkers, to more rigid linkers, in order to achieve the optimal length for effector domain activity for the specific application. In some embodiments, the more flexible linkers are glycine/serine-rich linkers (GS-rich linkers), where more than 45% (e.g., more than 48, 50, 55, 60, 70, 80, or 90%) of the residues are glycine or serine residues. Non-limiting examples of the GS-rich linkers are (GGGGS)n (SEQ ID NO: 485), (G)n (SEQ ID NO: 1260), and W linker. In some embodiments, the more rigid linkers are in the form of the form (EAAAK)n (SEQ ID NO: 487), (SGGS)n (SEQ ID NO: 488), and (XP)n (SEQ ID NO: 489). In the aforementioned formulae of flexible and rigid linkers, n may be any integer between 1 and 30. In some embodiments, n is 1, 2, 3, 4, 5, 6, 7, 8, 9, 10, 11, 12, 13, 14, or 15. In some embodiments, the linker comprises a (GGS)n motif, wherein n is 1, 3, or 7 (SEQ ID NO: 490). In some embodiments, the linker comprises a (GGGGS)n motif, wherein n is 4 (SEQ ID NO: 491).

In some embodiments, a linker in an epigenetic editor described herein comprises a nuclear localization signal, for example, with the amino acid sequence of any one of SEQ ID NOs: 1074-1079. In some embodiments, a linker in an epigenetic editor described herein comprises an expression tag, e.g., a detectable tag such as a green fluorescence protein.

B. Nuclear Localization Signals

A fusion protein described herein may comprise one or more nuclear localization signals, and in certain embodiments, may comprise two or more nuclear localization signals. For example, the fusion protein may comprise 1, 2, 3, 4, or 5 nuclear localization signals. As used herein, a "nuclear localization signal" (NLS) is an amino acid sequence that directs proteins to the nucleus. In certain embodiments, the NLS may be an SV40 NLS. The fusion protein may comprise an NLS at its N-terminus, C-terminus, or both, and/or an NLS may be embedded in the middle of the fusion protein (e.g., at the N- or C-terminus of a DNA-binding domain or an effector domain). In certain embodiments, an NLS comprises the amino acid sequence of any one of SEQ ID NOs: 1074-1079, or a sequence at least 75%, 80%, 85%, 90%, 91%, 92%, 93%, 94%, 95%, 96%, 97%, 98%, or 99% identical to the selected sequence. Additional NLSs are known in the art.

C. Tags

Epigenetic editors provided herein may comprise one or more additional sequences ("tags") for tracking, detection, and localization of the editors. In some embodiments, the epigenetic editor comprises 1, 2, 3, 4, 5, 6, 7, 8, 9, 10 or more detectable tags. Each of the detectable tags may be the same or different.

For example, an epigenetic editor fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, poly-histidine tags (also referred to as histidine tags or His-tags), maltose binding protein (MBP)-tags, nus-tags, glutathione-S-transferase (GST)-tags, green fluorescent protein (GFP)-tags, thioredoxin-tags, S-tags, Softags (e.g., Softag 1 or Softag 3), strep-tags, biotin ligase tags, FlAsH tags, V5 tags, and SBP-tags. Additional suitable sequences will be apparent to those of skill in the art. Sequences disclosed herein that are presented with tag sequences included are also contemplated without the presented tag sequences; similarly, sequences disclosed herein without tag sequences are also contemplated to include the addition of suitable tag sequences apparent to those of skill in the art.

D. Fusion Protein Configurations

A fusion protein of an epigenetic editor described herein may have its components structured in different configurations. For example, the DNA-binding domain may be at the C-terminus, the N-terminus, or in between two or more epigenetic effector domains or additional domains. In some embodiments, the DNA-binding domain is at the C-terminus of the epigenetic editor. In some embodiments, the DNA-binding domain is at the N-terminus of the epigenetic editor. In some embodiments, the DNA-binding domain is linked to one or more nuclear localization signals. In some embodiments, the DNA-binding domain is flanked by an epigenetic effector domain and/or an additional domain on both sides. In some embodiments, where "DBD" indicates DNA-binding domain and "ED" indicates effector domain, the epigenetic editor comprises the configuration of:

N']-[ED1]-[DBD]-[ED2]-[C'
N']-[ED1]-[DBD]-[ED2]-[ED3]-[C'
N']-[ED1]-[ED2]-[DBD]-[ED3]-[C' or
N']-[ED1]-[ED2]-DBD]-[ED3]-[ED4]-[C'].

In some embodiments, an epigenetic editor comprises a DNA-binding domain (DBD), a DNA methyltransferase (DNMT) domain, and a transcriptional repressor ("repressor") domain that represses or silences expression of a target gene. The DBD, DNMT, and transcriptional repressor domains may be any as described herein, in any combination. For example, an epigenetic editor can comprise a DBD, a DNMT3A domain, and a DNMT3L domain. An epigenetic editor can comprise a DBD, a DNMT3A domain, a DNMT3L domain, and preferably further comprise a KRAB domain. In some embodiments, the epigenetic editor comprises a fusion protein with the configuration of N']-[DNA methyltransferase domain]-[DBD]-[repressor domain]-[C'
N']-[repressor domain]-[DBD]-[DNA methyltransferase domain]-[C'
N']-[DNA methyltransferase domain]-[repressor domain]-[DBD]-[C' or
N']-[repressor domain]-[DNA methyltransferase domain]-[DBD]-[C'].

In some embodiments, a connecting structure "]-[" in any one of the epigenetic editor structures is a linker, e.g., a peptide linker; a detectable tag; a peptide bond; a nuclear localization signal; and/or a promoter or regulatory sequence. In an epigenetic editor structure, the multiple connecting structures "]-[" may be the same or may each be a different linker, tag, NLS, or peptide bond. In particular embodiments, the DNA methyltransferase domain comprises DNMT3A, DNMT3L, or both. In particular embodiments, the DBD is a catalytically inactive polynucleotide guided DNA-binding domain (e.g., a dCas9) or a ZFP domain. In particular embodiments, the repressor domain is a KRAB domain.

In some embodiments, the epigenetic editor comprises a configuration selected from N']-[DNMT3A-DNMT3L]-[DBD]-[KRAB]-[C'
N']-[KRAB]-[DBD]-[DNMT3A-DNMT3L]-[C'
N']-[KRAB]-[DBD]-[DNMT3A]-[C'
N']-[DNMT3A]-[DBD]-[KRAB]-[C'
N']-[KRAB]-[DBD]-[DNMT3A]-[DNMT3L]-[C'
N']-[DNMT3A]-[DNMT3L]-[DBD]-[KRAB]-[C'
N']-[DNMT3A]-[DBD]-[C'
N']-[DBD]-[DNMT3A]-[C'
N']-[DNMT3L]-[DBD]-[C'
N']-[DBD]-[DNMT3L]-[C' wherein [DNMT3A-DNMT3L] indicates that the DNMT3A and DNMT3L domains are directly fused via a peptide bond, and wherein the connecting structure]-[is any one of the linkers as described herein, a detectable tag, an affinity domain, a peptide bond, a nuclear localization signal, a promoter, and/or a regulatory sequence. The DBD, KRAB, DNMT3A, and DNMT3L domains may be any as described herein, in any combination. In particular embodiments, the DBD is a CRISPR-associated protein domain (e.g., dCas9) or a ZFP domain; the KRAB domain is derived from KOX1, ZIM3, ZFP28, or ZN627; the DNMT3A domain is a human DNMT3A domain; and the DNMT3L domain is a human or mouse DNMT3L domain; any combination of these components is also contemplated by the present disclosure.

In some embodiments, the epigenetic editor comprises a configuration selected from N']-[DNMT3A]-[DBD]-[SETDB1]-[C'
N']-[DNMT3A]-[DNMT3L]-[DBD]-[SETDB1]-[C'
N']-[DNMT3A-DNMT3L]-[DBD]-[SETDB1]-[C'
N']-[SETDB1]-[DBD]-[DNMT3A]-[DNMT3L]-[C'
N']-[SETDB1]-[DBD]-[DNMT3A]-[C' wherein [DNMT3A-DNMT3L] indicates that the DNMT3A and DNMT3L domains are directly fused via a peptide bond, and wherein the connecting structure]-[is any one of the linkers as described herein, a detectable tag, an affinity domain, a peptide bond, a nuclear localization signal, a promoter, and/or a regulatory sequence. The DBD, SETDB1, DNMT3A, and DNMT3L domains may be any as described herein, in any combination. In particular embodiments, the DBD is a CRISPR-associated protein domain (e.g., dCas9) or a ZFP domain; the SETDB1 domain is derived from human SETDB1, ZIM3, ZFP28, or ZN627; the DNMT3A domain is a human DNMT3A domain; and the DNMT3L domain is a human or mouse DNMT3L domain; any combination of these components is also contemplated by the present disclosure.

Particular constructs contemplated herein include:
DNMT3A-DNMT3L-XTEN80-NLS-dCas9-NLS-XTEN16-KOX1 KRAB (Configuration 1), and
DNMT3A-DNMT3L-XTEN80-NLS-ZFP domain-NLS-XTEN16-KOX1 KRAB (Configuration 2).

In particular embodiments, the DNMT3L and DNMT3A are both derived from human parental proteins. In particular embodiments, the DNMT3L and DNMT3A are derived from human and mouse parental proteins, respectively. In particular embodiments, the DNMT3L and DNMT3A are derived from mouse and human parental proteins, respectively. In particular embodiments, the DNMT3L and DNMT3A are both derived from mouse parental proteins. In some embodiments, the dCas9 is dSpCas9. In some embodiments, the KOX1 is human KOX1.

In particular embodiments, a fusion construct described herein may have Configuration 1 and comprise SEQ ID NO: 1080, or a sequence at least 75%, 80%, 85%, 90%, 91%, 92%, 93%, 94%, 95%, 96%, 97%, 98%, or 99% identical thereto. In SEQ ID NO: 1080 below, the XTEN linkers are underlined, the NLS sequences are bolded, the DNMT3A sequence is italicized, the DNMT3L sequence is underlined and italicized, the dCas9 domain is bolded and italicized, and the KOX1 KRAB domain is underlined and bolded:

```
                                      (SEQ ID NO: 1080)
MNHDQEFDPPKVYPPVPAEKRKPIRVLSLEDGIATGLLVLKDLGIQVDRY

IASEVCEDSITVGMVRHQGKIMYVGDVRSVTQKHIQEWGPFDLVIGGSPC

NDLSIVNPARKGLYEGTGRLFFEFYRLLHDARPKEGDDRPFFWLFENVVA

MGVSDKRDISRFLESNPVMIDAKEVSAAHRARYFWGNLPGMNRPLASTVN

DKLELQECLEHGRIAKESKVRTITTRSNSIKQGKDQHFPVFMNEKEDILW

CTEMERVFGFPVHYTDVSNMSRLARQRLLGRSWSVPVIRHLFAPLKEYFA

CVSSGNSNANSRGPSFSSGLVPLSLRGSHMGPMEIYKTVSAWKRQPVRVL

SLERNIDKVLKSLGFLESGSGSGGGTLKYVEDVTNVVRRDVEKWGPEDLV

YGSTQPLGSSCDRCPGWYMEQFHRILQYALPRQESQRPFFWIFMDNLLLT

EDDQETTTRFLQTEAVTLQDVRGRDYQNAMRVWSNIPGLKSKHAPLTPKE

EEYLQAQVRSRSKLDAPKVDLLVKNCLLPLREYFKYFSQNSLPLGGPSSG

APPPSGGSPAGSPTSTEEGTSESATPESGPGTSTEPSEGSAPGSPAGSPT

STEEGTSTEPSEGSAPGTSTEPSEPKKKRKVYMDKKYSIGLAIGTNSVGW

AVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPI

FGNIVDEVAYHEKYPTIYHLRKKLVDSTDKADLRLIYLALAHMIKERGHF

LIEGDLNPDNSDVDKLFIQLVQTYNQLFEENPINASGVDAKAILSARLSK

SRRLENLIAQLPGEKKNGLEGNLIALSLGLTPNEKSNEDLAEDAKLQLSK

DTYDDDLDNLLAQIGDQYADLFLAAKNLSDAILLSDILRVNTEITKAPLS

ASMIKRYDEHHQDLTLLKALVRQQLPEKYKEIFFDQSKNGYAGYIDGGAS

QEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRK

SEETITPWNFEEVVDKGASAQSFIERMTNEDKNLPNEKVLPKHSLLYEYF

TVYNELTKVKYVTEGMRKPAFLSGEQKKAIVDLLEKTNRKVTVKQLKEDY

FKKIECFDSVEISGVEDRENASLGTYHDLLKIIKDKDELDNEENEDILED

-continued

IVLTLTLFEDREMIEERLKTYAHLEDDKVMKQLKRRRYTGWGRLSRKLIN

GIRDKQSGKTILDELKSDGEANRNEMQLIHDDSLTFKEDIQKAQVSGQGD

SLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQN

GRDMYVDQELDINRLSDYDVDAIVPQSFLKDDSIDNKVLTRSDKNRGKSD

NVPSEEVVKKMKNYWRQLLNAKLITQRKEDNLTKAERGGLSELDKAGFIK

RQLVETRQITKHVAQILDSRMNTKYDENDKLIREVKVITLKSKLVSDERK

DFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDK

LIARKKDWDPKKYGGFDSPTVAYSVLVVAKVEKGKSKKLKSVKELLGITI

MERSSFEKNPIDFLEAKGYKEVKKDLIIKLPKYSLFELENGRKRMLASAG

ELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNL

GAPAAFKYFDTTIDRKRYTSTKEVLDATLIHQSITGLYETRIDLSQLGGD

PKKKRKVSGSETPGTSESATPESTGRTLVTFKDVFVDFTREEWKLLDTAQ

QIVYRNVMLENYKNLVSLGYQLTKPDVILRLEKGEEP
```

In particular embodiments, a fusion construct described herein may have Configuration 2 and comprise SEQ ID NO: 1081, or a sequence at least 75%, 80%, 85%, 90%, 91%, 92%, 93%, 94%, 95%, 96%, 97%, 98%, or 99% identical thereto. In SEQ ID NO: 1081 below, the XTEN linkers are underlined, the NLS sequences are bolded and underlined, the DNMT3A sequence is italicized, the DNMT3L sequence is underlined and italicized, the ZFP domain is bolded, and the KOX1 KRAB domain is underlined and bolded. Variable amino acids represented by Xs are the amino acids of the DNA-recognition helix of the zinc finger and XX in italics may be either TR, LR or LK.

```
MNHDQEFDPPKVYPPVPAEKRKPIRVLSLEDGIATGLLVLKDLGIQVDRY

IASEVCEDSITVGMVRHQGKIMYVGDVRSVTQKHIQEWGPEDLVIGGSPC

NDLSIVNPARKGLYEGTGRLFFEFYRLLHDARPKEGDDRPFFWLFENVVA

MGVSDKRDISRFLESNPVMIDAKEVSAAHRARYFWGNLPGMNRPLASTVN

DKLELQECLEHGRIAKFSKVRTITTRSNSIKQGKDQHFPVFMNEKEDILW

CTEMERVEGFPVHYTDVSNMSRLARQRLLGRSWSVPVIRHLFAPLKEYFA

CVSSGNSNANSRGPSESSGLVPLSLRGSHMGPMEIYKTVSAWKRQPVRVL

SLERNIDKVLKSLGFLESGSGSGGGTLKYVEDVTNVVRRDVEKWGPEDLV

YGSTQPLGSSCDRCPGWYMFQFHRILQYALPRQESQRPFFWIEMDNLLLT

EDDQETTTRELQTEAVTLQDVRGRDYQNAMRVWSNIPGLKSKHAPLTPKE

EEYLQAQVRSRSKLDAPKVDLLVKNCLLPLREYFKYFSQNSLPLGGPSSG

APPPSGGSPAGSPTSTEEGTSESATPESGPGTSTEPSEGSAPGSPAGSPT

STEEGTSTEPSEGSAPGTSTEPSEPKKKRKVYSRPGERPFQCRICMRNFS

XXXXXXXHXXTHTGEKPFQCRICMRNFSXXXXXXXHXXTH[linker]PF

QCRICMRNFSXXXXXXXHXXTHTGEKPFQCRICMRNFSXXXXXXXHXXTH
```

-continued

[linker]PFQCRICMRNFSXXXXXXXHXXTHTGEKPFQCRICMRNFSXX

XXXXXHXXTHLRGSPKKKRKVSGSETPGTSESATPESTGRTLVTFKDVFV

DFTREEWKLLDTAQQIVYRNVMLENYKNLVSLGYQLTKPDVILRLEKGEE

P (SEQ ID NOs: 1081, 1262 and 1263, respectively, in order of appearance)

In certain embodiments, the six "XXXXXXX" regions in SEQ ID NO: 1081, 1262 or 1263 comprise, in order, the F1-F6 amino acid sequences shown in Table 1. [linker] represents a linker sequence. In some embodiments, one or both linker sequences may be TGSQKP (SEQ ID NO: 1085). In some embodiments, one or both linker sequences may be TGGGGSQKP (SEQ ID NO: 1086). In some embodiments, one linker sequence may have the amino acid sequence of SEQ ID NO: 1085 and the other linker sequence may have the amino acid sequence of SEQ ID NO: 1086.

Multiple epigenetic editors may be used to effect activation or repression of a target gene or multiple target genes. For example, an epigenetic editor fusion protein comprising a DNA-binding domain (e.g., a dCas9 domain) and an effector domain may be co-delivered with two or more guide polynucleotides (e.g., gRNAs), each targeting a different target DNA sequence. The target sites for two of the DNA-binding domains may be the same or in the vicinity of each other, or separated by, for example, about 100 base pairs, about 200 base pairs, about 300 base pairs, about 400 base pairs, about 500 base pairs, or about 600 or more base pairs. In addition, when targeting double-strand DNA, such as an endogenous gene locus, the guide polynucleotides may target the same or different strands (one or more to the positive strand and/or one or more to the negative strand).

V. Target Sequences

An epigenetic editor herein may be directed to an HBV target sequence to effect epigenetic modification of HBV or an HBV gene. As used herein, a "target sequence," a "target site," or a "target region" is a nucleic acid sequence present in a genome or gene of interest, e.g., in an HBV genome or an HBV gene; in some instances, the target sequence may be outside but in the vicinity of the gene of interest wherein methylation or binding by a repressor of the target sequence represses expression of the gene. In some embodiments, the target sequence may be a hypomethylated or hypermethylated nucleic acid sequence.

The structure and biology of HBV as well as HBV-associated diseases have been reported (see, for example, Yuen, MF., Chen, DS., Dusheiko, G. et al. Hepatitis B virus infection. Nat Rev Dis Primers 4, 18035 (2018); R. Koshy and W. H. Caselman (Eds.), Hepatitis B Virus: Molecular Mechanism in Disease and Novel Strategies for Antiviral Therapy, Imperial College Press, London (1998), ISBN 1783262737; the entire contents of each of which are incorporated herein by reference). HBV genotypes and sub-types, as well as their genomic, transcript, and protein sequences have been described and are known to the skilled artisan. Some exemplary HBV sequences, e.g., those under accession numbers NC_00397 and U95551 are provided elsewhere herein, and the entire content of each such database entry is incorporated herein by reference.

Without wishing to be bound by any particular theory, it has been reported that HBV persists as a covalently closed circular DNA (cccDNA) of approximately 3.2 kb, as well as in an integrated form. The HBV genome has been extensively characterized. The HBV genome has been shown to comprise four genes (the S gene, the P gene, the C gene, and the X gene), regulated by four promoter elements (sp1, sp2, cp and xp) and two enhancer elements (Enh I and Enh II) that control the expression of four defined (and overlapping) protein-encoding open reading frames (S, C, X, and P). See FIG. 1. The HBV genome has been described to express six major viral RNA transcripts encoding the viral proteins: (1) the preCore (preC) RNA, which encodes the C protein (also referred to as Core protein, HBe Antigen, or HBeAg); (2), the pre-genomic (pg)RNA, which encodes the two viral proteins C (core) and P (polymerase), and also serves as the template for the synthesis of viral DNA, which is mediated by the reverse transcriptase activity of the viral P protein once pg RNA and the P protein are encapsidated into the nucleocapsids formed by the C protein; (3) the large surface protein (preS1) RNA, which encodes the Large S Antigen (also referred to as L-HBsAg); (4) the middle surface protein (preS2) RNA, which encodes the Middle S Antigen (also referred to as M-HBsAg); (5) the small surface protein (S) RNA, which encodes the Small S Antigen (also referred to as S-HBsAg); and (6) the X protein (HBx) RNA, which encodes the X protein. Transcription start sites (TSSs) as well as the termination site of the HBV transcripts have been mapped in various HBV genotypes and sub-types. Notably, HBV transcripts have been described to terminate at a single termination/polyadenylation signal located downstream of the Hbx CDS and comprising a canonical ATAAA motif. It has further been reported that HBV DNA may be methylated by infected cells and such methylation has been postulated to correlate with inhibition of viral gene expression. However, naturally occurring cell-mediated methylation of viral DNA is typically insufficient to silence viral expression to a level that would result in control of HBV infection. DNA methylation typically occurs at CpG dinucleotides. Several CpG-rich genomic regions, also referred to as CpG islands or CGIs, have been identified in the HBV genome. CGIs are typically identified in HBV genomic sequences as sequences of a specific minimal length (e.g., at least 100 bp) that comprise a minimum percentage of G and C nucleotides (e.g., at least 50% or at least 60% GC content) and a ratio of observed vs. expected CpG dinucleotides of at least 0.6. CGIs satisfying these criteria have been identified in all HBV genotypes, and it has been demonstrated that HBV genomes typically contain three CpG islands (CGI-I, CHI-II, and CGI-III, respectively), which are also sometimes referred to as 'conventional' HBV CpG islands. Some HBV genotypes or sub-types have been reported to comprise additional, 'non-conventional' CGIs. FIG. 1 is a diagram illustrating an exemplary structure of a circular HBV genome (the underlying sequence of which is provided herein as SEQ ID NO: 1082), identifying the coding regions of HBV genes and CpG islands CGI-I-III. See, for example, M. J. Kosovsky, et al., The regulation of hepatitis B virus gene expression: an overview of the cis- and trans-acting components in R. Koshy and W. H. Caselman (Eds.), Hepatitis B Virus: Molecular Mechanism in Disease and Novel Strategies for Antiviral Therapy, Imperial College Press, London (1998), ISBN 1783262737; Miller et al Compact organization of the hepatitis B virus genome. Hepatology. 1989 February; 9(2):322-7; Stadelmayer et al., Full-length 5'RACE identifies all major HBV transcripts in HBV-infected hepatocytes and patient serum. J Hepatol. 2020 July; 73(1):40-51; Meier-Stephenson et al., Comprehensive Analysis of Hepatitis B Virus Promoter Region Mutations. Viruses. 2018 Nov. 1; 10(11):603; Vivekanandan et al., Hepatitis B viral DNA is methylated in liver tissues. J Viral Hepat. 2008, 15(2):103-7; Chen et al., Detection of hepatitis B virus DNA in hepatocellular carcinoma: methylation of integrated viral DNA. J Virol Methods. 1988, 19(3-4):257-63; Zhang et al., Comparative Analysis of CpG Islands among HBV Genotypes. PLOS ONE 2013, 8(2): e56711; Jain et al., Comprehensive DNA methylation analysis of hepatitis B virus genome in infected liver tissues. Sci Rep 5, 10478 (2015); Low et al., Hepatitis B virus DNA methylation and its potential role in chronic hepatitis B. Expert Reviews in Molecular Medicine. 2023; 25:ell; Hou et al., CpG islands of hepatitis B virus genome isolated from Chinese patients. Gene (2015) 561:261-267; Mouzannar et al., The Post-Transcriptional Regulatory Element of Hepatitis B Virus: From Discovery to Therapy. Viruses. 2024 Mar. 29; 16(4):528; Peng et al., Nonproductive Hepatitis B Virus Covalently Closed Circular DNA Generates HBx-Related Transcripts from the HBx/Enhancer I Region and Acquires Reactivation by Superinfection in Single Cells. J Virol. 2023 Jan. 31; 97(1):e0171722; Altinel et al., Single-Nucleotide Resolution Mapping of Hepatitis B Virus Promoters in Infected Human Livers and Hepatocellular Carcinoma. J Virol. 2016 Nov. 14; 90(23):10811-10822; the entire contents of each of which, and, where applicable, including any supplemental information, are incorporated herein by reference.

The target sequence (also referred to herein as target site or target region) of an epigenetic editor provided herein may be any suitable HBV sequence.

The target sequence may be in any part of a target gene. In some embodiments, the target sequence is part of or near a noncoding sequence of the gene. In some embodiments, the target sequence is part of an exon of the gene. In some embodiments, the target sequence is part of or near a transcriptional regulatory sequence of the gene, such as a promoter or an enhancer. In some embodiments, the target sequence is adjacent to, overlaps with, or encompasses a CpG island, e.g., a CpG island identified within the HBV genome. In some embodiments, the target sequence is outside of a CpG island. In certain embodiments, the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS. In certain embodiments, the target sequence is within 500 bp flanking the HBV TSS. In certain embodiments, the target sequence is within 1000 bp flanking the HBV TSS.

Some exemplary embodiments in which the target sequence is part of a target gene are provided herein and additional embodiments will be apparent to the skilled artisan based on the present disclosure and the knowledge of the genomic structure of HBV in the art. For example, in some embodiments, the target sequence is part of the HBV S gene, the HBV P gene, the HBV C gene, or the HBV X gene. In some embodiments, the target sequence is part of the HBV S gene. In some embodiments, the target sequence is part of the HBV P gene. In some embodiments, the target sequence is part of the HBV C gene. In some embodiments, the target sequence is part of the HBV X gene. Some exemplary embodiments in which the target sequence is part of a noncoding sequence of a target gene are provided herein and additional embodiments will be apparent to the skilled artisan based on the present disclosure and the knowledge of the genomic structure of HBV in the art. For example, in some embodiments the target sequence is part of a noncoding sequence of the HBV S gene, of the HBV P gene, of the HBV C gene, or of the HBV X gene. For example, in some embodiments, the target sequence is part of a noncoding sequence of the HBV S gene. In some embodiments, the target sequence is part of a noncoding sequence of the HBV P gene. In some embodiments, the target sequence is part of a noncoding sequence of the HBV C gene. In some embodiments, the target sequence is part of a noncoding sequence of the HBV X gene. Noncoding sequences of the various HBV genes are known in the art and include, for example, the promoter and enhancer sequences of the HBV genome. Accordingly, in some embodiments, the target sequence is part of an HBV promoter sequence (e.g., of a promoter sequence within the HBV genome driving the transcription of one of the HBV transcripts described elsewhere herein, including, for example, of a sequence of the sp1, the sp2, the cp, and the xp promoter elements). In some embodiments, the target sequences is part of an HBV enhancer sequence (e.g., of the Enh I or of the Enh II sequence).

Some exemplary embodiments, in which the target sequence is adjacent to, overlaps with, or encompasses a CpG island, e.g., a CpG island identified within the HBV genome include embodiments in which the target sequence is adjacent to, overlaps with, or encompasses a conventional CGI of HBV, e.g., CGI I, CGI II, or CGI III. CGIs of HBV have been identified and described in numerous publications and are thus known to the skilled artisan. Bioinformatics tools for the identification of CGIs in any specific HBV sequence, e.g., in a sequence of a specific HBV genotype or sub-type, or in an HBV sequence isolated from a patient, are known in the art, including, for example, EMBOSS CpG plot (EMBL-EBI) and Methprimer (Li LC and Dahiya R. MethPrimer: designing primers for methylation PCRs. Bioinformatics. 2002 November; 18(11):1427-31). Conventional CGIs of HBV include CGI I, which overlaps the S and the P gene ORFs; CGI-II, which overlaps the P gene and X gene ORFs; and CGI III, which overlaps the C gene and P gene ORFs (see FIG. 1). In some embodiments, an HBV CGI is identified as a sequence within the HBV genome that is (1) at least 100 nucleotides long; (2) is characterized by a GC content of at least 50%; and (3) is characterized by an observed-to-expected CpG dinucleotide ratio of at least 0.6. According to these criteria, in the exemplary HBV genome referenced in FIG. 1, i.e., NC_003977 (provided herein as SEQ ID NO: 1082), CGI I spans nucleotides 186-288, CGI II spans nucleotides 1,217-1,670, and CGI III spans nucleotides 2,282-2,448 (see FIG. 1). CGIs of HBV fulfilling these criteria, including conventional HBV CGIs I-III, of other HBV sequences, including other genotypes, sub-types, or specific HBV sequences, will be apparent to the skilled artisan. In some embodiments, the target sequence overlaps with HBV CGI I. In some embodiments, the target sequence overlaps with HBV CGI II. In some embodiments, the target sequence overlaps with CGI III.

Exemplary embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS (transcription start site) include embodiments, in which the target sequence is within the respective number of base pairs of the TSS of any of the six major viral RNA transcripts, i.e., the TSS of the preCore (pre-C) RNA, the TSS of the pre-genomic (pg)RNA, the TSS of the large surface protein (preS1) RNA, the TSS of the middle surface protein (preS2) RNA, the TSS of the small surface protein (S) RNA, and the TSS of the X protein (HBx) RNA. The positions of the transcription start sites of the various HBV transcripts have been identified in various HBV genotypes and sub-types and are thus known to the skilled artisan. For example, for HBV of genotype D, as exemplified by NCBI database entries NC_003977 and U95551.1 (provided as SEQ ID NOs 1082 and 1083 herein), the TSS of the pg RNA transcript has been identified as nucleotide 1820, the TSS of the pre-C RNA as nucleotide 1791, and the TSS of the pre-S2 RNA as nucleotide 3159. The initiation of HBx RNA transcripts encoded by HBV genomes has been reported to not be limited to a single nucleotide, but to be spread over a short sequence. For example, TSSs for canonical HBx transcripts have been reported to initiate closely upstream of the first ATG in the sequence encoding the X protein, with HBx transcript TSS positions having been mapped to nucleotides 1243-1338 of HBV of genotype D, as exemplified by NCBI database entries NC_003977 and U95551.1 (provided as SEQ ID NOs 1082 and 1083 herein). TSSs for additional transcripts have also been identified and TSSs have been mapped to various HBV genotypes and sub-types.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV pg RNA TSS. For example, in some embodiments provided herein, the target sequence of an epigenetic editor is within 100 bp flanking an HBV pg RNA TSS, e.g., within 100 bp of nucleotide 1820 of SEQ ID NO: 1082 or 1083. In some embodiments provided herein, the target sequence of an epigenetic editor is within 200 bp flanking an HBV pg RNA TSS, e.g., within 200 bp of nucleotide 1820 of SEQ ID NO: 1082 or 1083. In some embodiments provided herein, the target sequence of an epigenetic editor is within 300 bp flanking an HBV pg RNA TSS, e.g., within 300 bp of nucleotide 1820 of SEQ ID NO: 1082 or 1083. In some embodiments provided herein, the target sequence of an epigenetic editor is within 400 bp flanking an HBV pg RNA TSS, e.g., within 400 bp of nucleotide 1820 of SEQ ID NO: 1082 or 1083. In some embodiments provided herein, the target sequence of an epigenetic editor is within 500 bp flanking an HBV pg RNA TSS, e.g., within 500 bp of nucleotide 1820 of SEQ ID NO: 1082 or 1083. In some embodiments provided herein, the target sequence of an epigenetic editor is within 600 bp flanking an HBV pg RNA TSS, e.g., within 600 bp of nucleotide 1820 of SEQ ID NO: 1082 or 1083.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV preCore (preC) RNA TSS. For example, in some embodiments provided herein, the target sequence of an epigenetic editor is within 100 bp flanking an HBV preC RNA TSS, e.g., within 100 bp of nucleotide 1791 of SEQ ID NO: 1082 or 1083. In some embodiments provided herein, the target sequence of an epigenetic editor is within 200 bp flanking an HBV preC RNA TSS, e.g., within 200 bp of nucleotide 1791 of SEQ ID NO: 1082 or 1083. In some embodiments provided herein, the target sequence of an epigenetic editor is within 300 bp flanking an HBV preC RNA TSS, e.g., within 300 bp of nucleotide 1791 of SEQ ID NO: 1082 or 1083. In some embodiments provided herein, the target sequence of an epigenetic editor is within 400 bp flanking an HBV preC RNA TSS, e.g., within 400 bp of nucleotide 1791 of SEQ ID NO: 1082 or 1083. In some embodiments provided herein, the target sequence of an epigenetic editor is within 500 bp flanking an HBV preC RNA TSS, e.g., within 500 bp of nucleotide 1791 of SEQ ID NO: 1082 or 1083.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV preS2 RNA TSS. For example, in some embodiments provided herein, the target sequence of an epigenetic editor is within 100 bp flanking an HBV preS2 RNA TSS, e.g., within 100 bp of nucleotide 3159 of SEQ ID NO: 1082 or 1083. In some embodiments provided herein, the target sequence of an epigenetic editor is within 200 bp flanking an HBV preS2 RNA TSS, e.g., within 200 bp of nucleotide 3159 of SEQ ID NO: 1082 or 1083. In some embodiments provided herein, the target sequence of an epigenetic editor is within 300 bp flanking an HBV preS2 RNA TSS, e.g., within 300 bp of nucleotide 3159 of SEQ ID NO: 1082 or 1083. In some embodiments provided herein, the target sequence of an epigenetic editor is within 400 bp flanking an HBV preS2 RNA TSS, e.g., within 400 bp of nucleotide 3159 of SEQ ID NO: 1082 or 1083. In some embodiments provided herein, the target sequence of an epigenetic editor is within 500 bp flanking an HBV preS2 RNA TSS, e.g., within 500 bp of nucleotide 3159 of SEQ ID NO: 1082 or 1083.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV HBx RNA TSS. For example, in some embodiments provided herein, the target sequence of an epigenetic editor is within 100 bp flanking an HBV HBx RNA TSS, e.g., within 100 bp of nucleotide 1243 of SEQ ID NO: 1082 or 1083. In some embodiments provided herein, the target sequence of an epigenetic editor is within 200 bp flanking an HBV HBx RNA TSS, e.g., within 200 bp of nucleotide 1243 of SEQ ID NO: 1082 or 1083. In some embodiments provided herein, the target sequence of an epigenetic editor is within 300 bp flanking an HBV HBx RNA TSS, e.g., within 300 bp of nucleotide 1243 of SEQ ID NO: 1082 or 1083. In some embodiments provided herein, the target sequence of an epigenetic editor is within 400 bp flanking an HBV HBx RNA TSS, e.g., within 400 bp of nucleotide 1243 of SEQ ID NO: 1082 or 1083. In some embodiments provided herein, the target sequence of an epigenetic editor is within 500 bp flanking an HBV HBx RNA TSS, e.g., within 500 bp of nucleotide 1243 of SEQ ID NO: 1082 or 1083. In some embodiments provided herein, the target sequence of an epigenetic editor is within 600 bp flanking an HBV HBx RNA TSS, e.g., within 600 bp of nucleotide 1243 of SEQ ID NO: 1082 or 1083.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV HBx RNA TSS. For example, in some embodiments provided herein, the target sequence of an epigenetic editor is within 100 bp flanking an HBV HBx RNA TSS, e.g., within 100 bp of nucleotide 1338 of SEQ ID NO: 1082 or 1083. In some embodiments provided herein, the target sequence of an epigenetic editor is within 200 bp flanking an HBV HBx RNA TSS, e.g., within 200 bp of nucleotide 1338 of SEQ ID NO: 1082 or 1083. In some embodiments provided herein, the target sequence of an epigenetic editor is within 300 bp flanking an HBV HBx RNA TSS, e.g., within 300 bp of nucleotide 1338 of SEQ ID NO: 1082 or 1083. In some embodiments provided herein, the target sequence of an epigenetic editor is within 400 bp flanking an HBV HBx RNA TSS, e.g., within 400 bp of nucleotide 1338 of SEQ ID NO: 1082 or 1083. In some embodiments provided herein, the target sequence of an epigenetic editor is within 500 bp flanking an HBV HBx RNA TSS, e.g., within 500 bp of nucleotide 1338 of SEQ ID NO: 1082 or 1083. In some embodiments provided herein, the target sequence of an epigenetic editor is within 600 bp flanking an HBV HBx RNA TSS, e.g., within 600 bp of nucleotide 1338 of SEQ ID NO: 1082 or 1083.

In some embodiments in which the target sequence is within about 3000, 2900, 2800, 2700, 2600, 2500, 2400, 2300, 2200, 2100, 2000, 1900, 1800, 1700, 1600, 1500, 1400, 1300, 1200, 1100, 1000, 900, 800, 700, 600, 500, 400, 300, 200, or 100 base pairs (bp) flanking an HBV TSS, the HBV TSS is an HBV HBx RNA TSS. For example, in some embodiments provided herein, the target sequence of an epigenetic editor is within 100 bp flanking an HBV HBx RNA TSS, e.g., within 100 bp of nucleotide 1243 and within 100 bp of nucleotide 1338 of SEQ ID NO: 1082 or 1083. In some embodiments provided herein, the target sequence of an epigenetic editor is within 200 bp flanking an HBV HBx RNA TSS, e.g., within 200 bp of nucleotide 1243 and within 200 bp of nucleotide 1338 of SEQ ID NO: 1082 or 1083. In some embodiments provided herein, the target sequence of an epigenetic editor is within 300 bp flanking an HBV HBx RNA TSS, e.g., within 300 bp of nucleotide 1243 and within 300 bp of nucleotide 1338 of SEQ ID NO: 1082 or 1083. In some embodiments provided herein, the target sequence of an epigenetic editor is within 400 bp flanking an HBV HBx RNA TSS, e.g., within 400 bp of nucleotide 1243 and within 400 bp of nucleotide 1338 of SEQ ID NO: 1082 or 1083. In some embodiments provided herein, the target sequence of an epigenetic editor is within 500 bp flanking an HBV HBx RNA TSS, e.g., within 500 bp of nucleotide 1243 and within 500 bp of nucleotide 1338 of SEQ ID NO: 1082 or 1083. In some embodiments provided herein, the target sequence of an epigenetic editor is within 600 bp flanking an HBV HBx RNA TSS, e.g., within 600 bp of nucleotide 1243 and within 600 bp of nucleotide 1338 of SEQ ID NO: 1082 or 1083.

In some embodiments, the target sequence may hybridize to a guide polynucleotide sequence (e.g., gRNA) complexed with a fusion protein comprising a polynucleotide guided DNA-binding domain (e.g., a CRISPR protein such as dCas9) and effector domain(s). The guide polynucleotide sequence may be designed to have complementarity to the target sequence, or identity to the opposing strand of the target sequence. In some embodiments, the guide polynucleotide comprises a spacer sequence that is about 80%, 85%, 90%, 91%, 92%, 93%, 94%, 95%, 96%, 97%, 98% or 99% identical to a protospacer sequence in the target sequence. In particular embodiments, the guide polynucleotide comprises a spacer sequence that is 100% identical to a protospacer sequence in the target sequence.

In some embodiments, where the DNA-binding domain of an epigenetic editor described herein is a zinc finger array, the target sequence may be recognized by said zinc finger array.

In some embodiments, where the DNA-binding domain of an epigenetic editor described herein is a TALE, the target sequence may be recognized by said TALE.

A target sequence described herein may be specific to one genotype of HBV, to one copy of am HBV target gene, or may be specific to one allele of an HBV target gene. In some embodiments, however, the target sequence may be conserved across two or more HBV genotypes, across two or more copies of an HBV gene, and across alleles of an HBV gene. Accordingly, the epigenetic modification and modulation of expression thereof may be specific to one copy or one allele of the target gene, or, in other embodiments, may be universal to different HBV genotypes, or HBV gene copies or alleles.

In some embodiments, the target sequence is comprised in the following sequence:

```
>NC_003977.2 Hepatitis B virus (strain ayw)
genome
                                    (SEQ ID No. 1082)
AATTCCACAACCTTCCACCAAACTCTGCAAGATCCCAGAGTGAGAGGCCT

GTATTTCCCTGCTGGTGGCTCCAGTTCAGGAACAGTAAACCCTGTTCTGA

CTACTGCCTCTCCCTTATCGTCAATCTTCTCGAGGATTGGGGACCCTGCG

CTGAACATGGAGAACATCACATCAGGATTCCTAGGACCCCTTCTCGTGTT

ACAGGCGGGGTTTTTCTTGTTGACAAGAATCCTCACAATACCGCAGAGTC

TAGACTCGTGGTGGACTTCTCTCAATTTTCTAGGGGGAACTACCGTGTGT

CTTGGCCAAAATTCGCAGTCCCCAACCTCCAATCACTCACCAACCTCTTG

TCCTCCAACTTGTCCTGGTTATCGCTGGATGTGTCTGCGGCGTTTTATCA

TCTTCCTCTTCATCCTGCTGCTATGCCTCATCTTCTTGTTGGTTCTTCTG

GACTATCAAGGTATGTTGCCCGTTTGTCCTCTAATTCCAGGATCCTCAAC

AACCAGCACGGGACCATGCCGGACCTGCATGACTACTGCTCAAGGAACCT

CTATGTATCCCTCCTGTTGCTGTACCAAACCTTCGGACGGAAATTGCACC

TGTATTCCCATCCCATCATCCTGGGCTTTCGGAAAATTCCTATGGGAGTG

GGCCTCAGCCCGTTTCTCCTGGCTCAGTTTACTAGTGCCATTTGTTCAGT

GGTTCGTAGGGCTTTCCCCCACTGTTTGGCTTTCAGTTATATGGATGATG

TGGTATTGGGGGCCAAGTCTGTACAGCATCTTGAGTCCCTTTTTACCGCT

GTTACCAATTTTCTTTTGTCTTTGGGTATACATTTAAACCCTAACAAAAC

AAAGAGATGGGGTTACTCTCTAAATTTTATGGGTTATGTCATTGGATGTT

ATGGGTCCTTGCCACAAGAACACATCATACAAAAAATCAAAGAATGTTTT

AGAAAACTTCCTATTAACAGGCCTATTGATTGGAAAGTATGTCAACGAAT

TGTGGGTCTTTTGGGTTTTGCTGCCCCTTTTACACAATGTGGTTATCCTG

CGTTGATGCCTTTGTATGCATGTATTCAATCTAAGCAGGCTTTCACTTTC

TCGCCAACTTACAAGGCCTTTCTGTGTAAACAATACCTGAACCTTTACCC

CGTTGCCCGGCAACGGCCAGGTCTGTGCCAAGTGTTTGCTGACGCAACCC

CCACTGGCTGGGGCTTGGTCATGGGCCATCAGCGCATGCGTGGAACCTTT

TCGGCTCCTCTGCCGATCCATACTGCGGAACTCCTAGCCGCTTGTTTTGC

TCGCAGCAGGTCTGGAGCAAACATTATCGGGACTGATAACTCTGTTGTCC

TATCCCGCAAATATACATCGTTTCCATGGCTGCTAGGCTGTGCTGCCAAC

TGGATCCTGCGCGGGACGTCCTTTGTTTACGTCCCGTCGGCGCTGAATCC

TGCGGACGACCCTTCTCGGGGTCGCTTGGGACTCTCTCGTCCCCTTCTCC

GTCTGCCGTTCCGACCGACCACGGGGCGCACCTCTCTTTACGCGGACTCC

CCGTCTGTGCCTTCTCATCTGCCGGACCGTGTGCACTTCGCTTCACCTCT
```

-continued

```
GCACGTCGCATGGAGACCACCGTGAACGCCCACCAAATATTGCCCAAGGT
CTTACATAAGAGGACTCTTGGACTCTCAGCAATGTCAACGACCGACCTTG
AGGCATACTTCAAAGACTGTTTGTTTAAAGACTGGGAGGAGTTGGGGGAG
GAGATTAGGTTAAAGGTCTTTGTACTAGGAGGCTGTAGGCATAAATTGGT
CTGCGCACCAGCACCATGCAACTTTTTCACCTCTGCCTAATCATCTCTTG
TTCATGTCCTACTGTTCAAGCCTCCAAGCTGTGCCTTGGGTGGCTTTGGG
GCATGGACATCGACCCTTATAAAGAATTTGGAGCTACTGTGGAGTTACTC
TCGTTTTTGCCTTCTGACTTCTTTCCTTCAGTACGAGATCTTCTAGATAC
CGCCTCAGCTCTGTATCGGGAAGCCTTAGAGTCTCCTGAGCATTGTTCAC
CTCACCATACTGCACTCAGGCAAGCAATTCTTTGCTGGGGGAACTAATG
ACTCTAGCTACCTGGGTGGGTGTTAATTTGGAAGATCCAGCGTCTAGAGA
CCTAGTAGTCAGTTATGTCAACACTAATATGGGCCTAAAGTTCAGGCAAC
TCTTGTGGTTTCACATTTCTTGTCTCACTTTTGGAAGAGAAACAGTTATA
GAGTATTTGGTGTCTTTCGGAGTGTGGATTCGCACTCCTCCAGCTTATAG
ACCACCAAATGCCCCTATCCTATCAACACTTCCGGAGACTACTGTTGTTA
GACGACGAGGCAGGTCCCCTAGAAGAAGAACTCCCTCGCCTCGCAGACGA
AGGTCTCAATCGCCGCGTCGCAGAAGATCTCAATCTCGGGAATCTCAATG
TTAGTATTCCTTGGACTCATAAGGTGGGGAACTTTACTGGGCTTTATTCT
TCTACTGTACCTGTCTTTAATCCTCATTGGAAAACACCATCTTTTCCTAA
TATACATTTACACCAAGACATTATCAAAAAATGTGAACAGTTTGTAGGCC
CACTCACAGTTAATGAGAAAGAAGATTGCAATTGATTATGCCTGCCAGG
TTTTATCCAAAGGTTACCAAATATTTACCATTGGATAAGGGTATTAAACC
TTATTATCCAGAACATCTAGTTAATCATTACTTCCAAACTAGACACTATT
TACACACTCTATGGAAGGCGGGTATATTATATAAGAGAGAAACAACACAT
AGCGCCTCATTTTGTGGGTCACCATATTCTTGGGAACAAGATCTACAGCA
TGGGGCAGAATCTTTCCACCAGCAATCCTCTGGGATTCTTTCCCGACCAC
CAGTTGGATCCAGCCTTCAGAGCAAACACCGCAAATCCAGATTGGGACTT
CAATCCCAACAAGGACACCTGGCCAGACGCCAACAAGGTAGGAGCTGGAG
CATTCGGGCTGGGTTTCACCCCACCGCACGGAGGCCTTTTGGGGTGGAGC
CCTCAGGCTCAGGGCATACTACAAACTTTGCCAGCAAATCCGCCTCCTGC
CTCCACCAATCGCCAGTCAGGAAGGCAGCCTACCCCGCTGTCTCCACCTT
TGAGAAACACTCATCCTCAGGCCATGCAGTGG
```

FIG. 1 provides a diagram illustrating the structure of a circular HBV genome comprising SEQ ID NO: 1082. The coding regions of the HBV genes

```
TGTGGGTCTTTTGGGTTTTGCTGCCCCATTTACACAATGTGGTTATCCTG

CGTTAATGCCCTTGTATGCATGTATTCAATCTAAGCAGGCTTTCACTTTC

TCGCCAACTTACAAGGCCTTTCTGTGTAAACAATACCTGAACCTTTACCC

CGTTGCCCGGCAACGGCCAGGTCTGTGCCAAGTGTTTGCTGACGCAACCC

CCACTGGCTGGGGCTTGGTCATGGGCCATCAGCGCGTGCGTGGAACCTTT

TCGGCTCCTCTGCCGATCCATACTGCGGAACTCCTAGCCGCTTGTTTTGC

TCGCAGCAGGTCTGGAGCAAACATTATCGGGACTGATAACTCTGTTGTCC

TCTCCCGCAAATATACATCGTATCCATGGCTGCTAGGCTGTGCTGCCAAC

TGGATCCTGCGCGGGACGTCCTTTGTTTACGTCCCGTCGGCGCTGAATCC

TGCGGACGACCCTTCTCGGGGTCGCTTGGGACTCTCTCGTCCCCTTCTCC

GTCTGCCGTTCCGACCGACCACGGGGCGCACCTCTCTTTACGCGGACTCC

CCGTCTGTGCCTTCTCATCTGCCGGACCGTGTGCACTTCGCTTCACCTCT

GCACGTCGCATGGAGACCACCGTGAACGCCCACCGAATGTTGCCCAAGGT

CTTACATAAGAGGACTCTTGGACTCTCTGCAATGTCAACGACCGACCTTG

AGGCATACTTCAAAGACTGTTTGTTTAAAGACTGGGAGGAGTTGGGGGAG

GAGATTAGATTAAAGGTCTTTGTACTAGGAGGCTGTAGGCATAAATTGGT

CTGCGCACCAGCACCATGCAACTTTTTCACCTCTGCCTAATCATCTCTTG

TTCATGTCCTACTGTTCAAGCCTCCAAGCTGTGCCTTGGGTGGCTTTGGG

GCATGGACATCGACCCTTATAAAGAATTTGGAGCTACTGTGGAGTTACTC

TCGTTTTTGCCTTCTGACTTCTTTCCTTCAGTACGAGATCTTCTAGATAC

CGCCTCAGCTCTGTATCGGGAAGCCTTAGAGTCTCCTGAGCATTGTTCAC

CTCACCATACTGCACTCAGGCAAGCAATTCTTTGCTGGGGGAACTAATG

ACTCTAGCTACCTGGGTGGGTGTTAATTTGGAAGATCCAGCATCTAGAGA

CCTAGTAGTCAGTTATGTCAACACTAATATGGGCCTAAAGTTCAGGCAAC

TCTTGTGGTTTCACATTTCTTGTCTCACTTTTGGAAGAGAAACCGTTATA

GAGTATTTGGTGTCTTTCGGAGTGTGGATTCGCACTCCTCCAGCTTATAG

ACCACCAAATGCCCCTATCCTATCAACACTTCCGGAAACTACTGTTGTTA

GACGACGAGGCAGGTCCCCTAGAAGAAGAACTCCCTCGCCTCGCAGACGA

AGGTCTCAATCGCCGCGTCGCAGAAGATCTCAATCTCGGGAACCTCAATG

TTAGTATTCCTTGGACTCATAAGGTGGGGAACTTTACTGGTCTTTATTCT

TCTACTGTACCTGTCTTTAATCCTCATTGGAAAACACCATCTTTTCCTAA

TATACATTTACACCAAGACATTATCAAAAAATGTGAACAGTTTGTAGGCC

CACTTACAGTTAATGAGAAAAGAAGATTGCAATTGATTATGCCTGCTAGG

TTTTATCCAAAGGTTACCAAATATTTACCATTGGATAAGGGTATTAAACC

TTATTATCCAGAACATCTAGTTAATCATTACTTCCAAACTAGACACTATT

TACACACTCTATGGAAGGCGGGTATATTATATAAGAGAGAAACAACACAT

AGCGCCTCATTTTGTGGGTCACCATATTCTTGGGAACAAGATCTACAGCA

TGGGGCAGAATCTTTCCACCAGCAATCCTCTGGGATTCTTTCCCGACCAC

CAGTTGGATCCAGCCTTCAGAGCAAACACAGCAAATCCAGATTGGGACTT

CAATCCCAACAAGGACACCTGGCCAGACGCCAACAAGGTAGGAGCTGGAG

CATTCGGGCTGGGTTTCACCCCACCGCACGGAGGCCTTTTGGGGTGGAGC

CCTCAGGCTCAGGGCATACTACAAACTTTGCCAGCAAATCCGCCTCCTGC

CTCCACCAATCGCCAGACAGGAAGGCAGCCTACCCCGCTGTCTCCACCTT

TGAGAAACACTCATCCTCAGGCCATGCAGTGG.
```

Annotation of SEQ ID NO: 1083: P protein CDS: 2309-1625; L-HBsAG CDS: 2850-837; M-HBsAg CDS: 3174-837; S-HBsAg CDS: 157-837; C Protein CDS: 1816-2454; X protein CDS: 1376-1840; CGI: 186-288; CGI II: 1,217-1,670; CGI III: 2,282-2,448; pg RNA TSS: 1820; pre-C RNA TSS: 1791; pre-S2 RNA TSS: 3159; HBx RNA TSSs: 1243-1338; termination/polyA site: 1919. See references cited elsewhere herein.

VI. Epigenetic Modifications

An epigenetic editor described herein may perform sequence-specific epigenetic modification(s) (e.g., alteration of chemical modification(s)) of a target gene that harbors the target sequence. Such epigenetic modulation may be safer and more easily reversible than modulation due to gene editing, e.g., with generation of DNA double-strand breaks. In some embodiments, the epigenetic modulation may reduce or silence the target gene. In some embodiments, the modification is at a specific site of the target sequence. In some embodiments, the modification is at a specific allele of the target gene. Accordingly, the epigenetic modification may result in modulated (e.g., reduced) expression of one copy of a target gene harboring a specific allele, and not the other copy of the target gene. In some embodiments, the specific allele is associated with a disease, condition, or disorder.

In some embodiments, the epigenetic modification reduces or abolishes transcription of the target gene harboring the target sequence. In some embodiments, the epigenetic modification reduces or abolishes transcription of a copy of the target gene harboring a specific allele recognized by the epigenetic editor. In some embodiments, the epigenetic editor reduces the level of or eliminates expression of a protein encoded by the target gene. In some embodiments, the epigenetic editor reduces the level of or eliminates expression of a protein encoded by a copy of the target gene harboring a specific allele recognized by the epigenetic editor. The target HBV gene may be epigenetically modified in vitro, ex vivo, or in vivo.

The effector domain of an epigenetic editor described herein may alter (e.g., deposit or remove) a chemical modification at a nucleotide of the target gene or at a histone associated with the target gene. The chemical modification may be altered at a single nucleotide or a single histone, or may be altered at 2, 3, 4, 5, 6, 7, 8, 9, 10, 11, 12, 13, 14, 15, 16, 17, 18, 19, 20, 30, 40, 50, 60, 70, 80, 90, 100, 200, 300, 400, 500, 600, 700, 800, 900, 1000, 1500, 2000, 2500, 3000 or more nucleotides.

In some embodiments, an effector domain of an epigenetic editor described herein may alter a CpG dinucleotide within the target gene. In some embodiments, all CpG dinucleotides within 2000, 1500, 1000, 500, or 200 bps flanking a target sequence (e.g., in an alteration site as described herein) are altered according to a modification type described herein, as compared to the original state of the gene or the gene in a comparable cell not contacted with the epigenetic editor. In some embodiments, at least 1, 2, 3, 4, 5, 6, 7, 8, 9, 10, 11, 12, 13, 14, 15, 16, 17, 18, 19, 20, 25, 30, 35, 40, 45, 50, 60, 70, 80, 90, 100, 150, 200, 250, 300, 350, 400, 450, 500, 550, 600, 650, 700 or more of the CpG dinucleotides are altered as compared to the original state of the gene or the gene in a comparable cell not contacted with the epigenetic editor. In some embodiments, at least 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 96%, 97%, 98%, or 99% of the CpG dinucleotides are altered as compared to the original state of the gene or the gene in a comparable cell not contacted with the epigenetic editor. In some embodiments, one single CpG dinucleotide is altered, as compared to the original state of the gene or the gene in a comparable cell not contacted with the epigenetic editor.

An effector domain of an epigenetic editor described herein may alter a histone modification state of a histone associated with or bound to the target gene. For example, an effector domain may deposit a modification on one or more lysine residues of histone tails of histones associated with the target gene. In some embodiments, the effector domain may result in deacetylation of one or more histone tails of histones associated with the target gene, thereby reducing or silencing expression of the target gene. In some embodiments, the histone modification state is a methylation state. For example, the effector domain may result in a H3K9, H3K27 or H4K20 methylation (e.g. one or more of a H3K9me2, H3K9me3, H3K27me2, H3K27me3, and H4K20me3 methylation) at one or more histone tails associated with the target gene, thereby reducing or silencing expression of the target gene.

In some embodiments, all histone tails of histones bound to DNA nucleotides within 2000, 1500, 1000, 500, or 200 bps flanking the target sequence are altered according to a modification type as described herein, as compared to the original state of the chromosome or the chromosome in a comparable cell not contacted with the epigenetic editor. In some embodiments, at least 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 105, 110, 115, 120 or more histone tails of the bound histones are altered as compared to the original state of the chromosome or the chromosome in a comparable cell not contacted with the epigenetic editor. In some embodiments, at least 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 96%, 97%, 98%, or 99% of histone tails of the bound histones are altered as compared to the original state of the chromosome or the chromosome in a comparable cell not contacted with the epigenetic editor. For example, one single histone tail of the bound histones may be altered as compared to the original state of the chromosome or the chromosome in a comparable cell not contacted with the epigenetic editor. As another example, one single bound histone octamer may be altered as compared to the original state of the chromosome or the chromosome in a comparable cell not contacted with the epigenetic editor.

The chemical modification deposited at target gene DNA nucleotides or histone residues may be at or in close proximity to a target sequence in the target gene. In some embodiments, an effector domain of an epigenetic editor described herein alters a chemical modification state of a nucleotide or histone tail bound to a nucleotide 100-200, 200-300, 300-400, 400-55, 500-600, 600-700, or 700-800 nucleotides 5' or 3' to the target sequence in the target gene. In some embodiments, an effector domain alters a chemical modification state of a nucleotide or histone tail bound to a nucleotide within 10, 20, 30, 40, 50, 60, 70, 80, 90, 100, 200, 300, 400, 500, 600, 700, 800, 900, 1000, 1100, 1200, 1300, 1400, 1500, 1600, 1700, 1800, 1900, or 2000 nucleotides flanking the target sequence. As used herein, "flanking" refers to nucleotide positions 5' to the 5' end of and 3' to the 3' end of a particular sequence, e.g. a target sequence.

In some embodiments, an effector domain mediates or induces a chemical modification change of a nucleotide or a histone tail bound to a nucleotide distant from a target sequence. Such modification may be initiated near the target sequence, and may subsequently spread to one or more nucleotides in the target gene distant from the target sequence. For example, an effector domain may initiate alteration of a chemical modification state of one or more nucleotides or one or more histone residues bound to one or more nucleotides within 10, 20, 30, 40, 50, 60, 70, 80, 90, 100, 200, 300, 400, 500 nucleotides flanking the target sequence, and the chemical modification state alteration may spread to one or more nucleotides at least 100, 200, 300, 400, 500, 600, 700, 800, 900, 1000, 1100, 1200, 1300, 1400, 1500, 1600, 1700, 1800, 1900, 2000, 2500, 3000, or more nucleotides from the target sequence in the target gene, either upstream or downstream of the target sequence. In certain embodiments, the chemical modification may be initiated at less than 2, 3, 5, 10, 20, 30, 40, 50, or 100 nucleotides in the target gene and spread to at least 100, 200, 300, 400, 500, 600, 700, 800, 900, 1000, 2000, or more nucleotides in the target gene. In some embodiments, the chemical modification spreads to nucleotides in the entire target gene. Additional proteins or transcription factors, for example, transcription repressors, methyltransferases, or transcription regulation scaffold proteins, may be involved in the spreading of the chemical modification. Alternatively, the epigenetic editor alone may be involved.

In some embodiments, an epigenetic editor described herein reduces expression of a target gene by at least about 20%, at least about 30%, at least about 40%, at least about 50%, at least about 60%, at least about 70%, at least about 80%, at least about 90%, at least about 95%, at least about 99%, or more, as measured by transcription of the target gene in a cell, a tissue, or a subject as compared to a control cell, control tissue, or a control subject (e.g., in the absence of the epigenetic editor). In some embodiments, the epigenetic editors described herein reduces expression of a copy of target gene by at least about 20%, at least about 30%, at least about 40%, at least about 50%, at least about 60%, at least about 70%, at least about 80%, at least about 90%, at least about 95%, at least about 99%, at least about 99.9%, or more, as measured by transcription of the copy of the target gene in a cell, a tissue, or a subject as compared to a control cell, control tissue, or a control subject. For example, in some embodiments, an epigenetic editor described herein reduces expression of an HBV target gene in vitro or in vivo (e.g., as measured as the level of an HBV biomarker in a subject), by at least 20%, at least 30%, at least 40%, at least 50%, at least 60%, at least 70%, at least 80%, at least 90%, at least 95%, at least 99%, at least 99.9%, or more, as measured for example, by transcription of the target gene, or by assessing an HBV biomarker (e.g., plasma HBV DNA, plasma HBVsAg, or plasma HBVeAg) in a cell, a tissue, or a subject contacted or administered with the epigenetic editor as compared to a control cell, control tissue, or a control subject (e.g., in the absence of the epigenetic editor). In certain embodiments, the copy of the target gene harbors a specific sequence or allele recognized by the epigenetic editor. In particular embodiments, the epigenetically modified copy encodes a functional protein, and accordingly an epigenetic editor disclosed herein may reduce or abolish expression and/or function of the protein. For example, an epigenetic editor described herein may reduce expression and/or function of a protein encoded by the target gene by at least 3-fold, at least 4-fold, at least 5-fold, at least 6-fold, at least 7-fold, at least 8-fold, at least 9-fold, at least 10-fold, at least 11-fold, at least 12-fold, at least 13-fold, at least 14-fold, at least 15-fold, at least 20-fold, at least 25-fold, at least 30-fold, at least 35-fold, at least 40-fold, at least 45-fold, at least 50-fold, at least 60-fold, at least 70-fold, at least 80-fold, at least 90-fold, or at least 100 fold in a cell, a tissue, or a subject as compared to a control cell, control tissue, or a control subject.

Modulation of target gene expression can be assayed by determining any parameter that is indirectly or directly affected by the expression of the target gene. Such parameters include, e.g., changes in RNA or protein levels; changes in protein activity; changes in product levels; changes in downstream gene expression; changes in transcription or activity of reporter genes such as, for example, luciferase, CAT, beta-galactosidase, or GFP; changes in signal transduction; changes in phosphorylation and dephosphorylation; changes in receptor-ligand interactions; changes in concentrations of second messengers such as, for example, cGMP, cAMP, IP3, and $Ca^{2+}$; changes in cell growth; changes in neovascularization; and/or changes in any functional effect of gene expression. Measurements can be made in vitro, in vivo, and/or ex vivo, and can be made by conventional methods, e.g., measurement of RNA or protein levels, measurement of RNA stability, and/or identification of downstream or reporter gene expression. Readout can be by way of, for example, chemiluminescence, fluorescence, colorimetric reactions, antibody binding, inducible markers, ligand binding assays, changes in intracellular second messengers such as cGMP and inositol triphosphate (IP3), changes in intracellular calcium levels; cytokine release, and the like.

Methods for determining the expression level of a gene, for example the target of an epigenetic editor, may include, e.g., determining the transcript level of a gene by reverse transcription PCR, quantitative RT-PCR, droplet digital PCR (ddPCR), Northern blot, RNA sequencing, DNA sequencing (e.g., sequencing of complementary deoxyribonucleic acid (cDNA) obtained from RNA); next generation (Next-Gen) sequencing, nanopore sequencing, pyrosequencing, or Nanostring sequencing. Levels of protein expressed from a gene may be determined, e.g., by Western blotting, enzyme linked immuno-absorbance assays, mass-spectrometry, immunohistochemistry, or flow cytometry analysis. Gene expression product levels may be normalized to an internal standard such as total messenger ribonucleic acid (mRNA) or the expression level of a particular gene, e.g., a housekeeping gene.

In some embodiments, the effect of an epigenetic editor in modulating target gene expression may be examined using a reporter system. For example, an epigenetic editor may be designed to target a reporter gene encoding a reporter protein, such as a fluorescent protein. Expression of the reporter gene in such a model system may be monitored by, e.g., flow cytometry, fluorescence-activated cell sorting (FACS), or fluorescence microscopy. In some embodiments, a population of cells may be transfected with a vector that harbors a reporter gene. The vector may be constructed such that the reporter gene is expressed when the vector transfects a cell. Suitable reporter genes include genes encoding fluorescent proteins, for example green, yellow, cherry, cyan or orange fluorescent proteins. The population of cells carrying the reporter system may be transfected with DNA, mRNA, or vectors encoding the epigenetic editor targeting the reporter gene.

VII. Pharmaceutical Compositions

Another aspect of the present disclosure is a pharmaceutical composition comprising as an active ingredient (or as the sole active ingredient) one or more epigenetic editors described herein or component(s) (e.g., fusion proteins and/or guide polynucleotides) thereof, or nucleic acid molecule(s) encoding said epigenetic editors or component(s) thereof. For example, a pharmaceutical composition may comprise nucleic acid molecule(s) encoding the fusion protein(s) (and guide polynucleotides, where applicable) of an epigenetic editor described herein. In some embodiments, separate pharmaceutical compositions comprise the fusion protein(s) and the guide polynucleotide(s). In some embodiments, multiple pharmaceutical compositions, each comprising one epigenetic editor, are administered simultaneously. A pharmaceutical composition may also comprise cells that have undergone epigenetic modification(s) mediated or induced by an epigenetic editor provided herein.

Generally, the epigenetic editors described herein or component(s) thereof, or nucleic acid molecule(s) encoding said epigenetic editors or component(s) thereof, of the present disclosure are suitable to be administered as a formulation in association with one or more pharmaceutically acceptable excipient(s), e.g., as described below.

The term "excipient" is used herein to describe any ingredient other than the compound(s) of the present disclosure. The choice of excipient(s) will to a large extent depend on factors such as the particular mode of administration, the effect of the excipient on solubility and stability, and the nature of the dosage form. As used herein, "pharmaceutically acceptable excipient" includes any and all solvents, dispersion media, coatings, antibacterial and antifungal agents, isotonic and absorption delaying agents, and the like that are physiologically compatible. Some examples of pharmaceutically acceptable excipients are water, saline, phosphate buffered saline, dextrose, glycerol, ethanol and the like, as well as combinations thereof. In many cases, it will be preferable to include isotonic agents, for example, sugars, polyalcohols such as mannitol, sorbitol, or sodium chloride in the composition. Additional examples of pharmaceutically acceptable substances are wetting agents or minor amounts of auxiliary substances such as wetting or emulsifying agents, preservatives, or buffers, which enhance the shelf life or effectiveness of the antibody.

Formulations of a pharmaceutical composition suitable for parenteral administration typically comprise the active ingredient combined with a pharmaceutically acceptable carrier, such as sterile water or sterile isotonic saline. Such formulations may be prepared, packaged, or sold in a form suitable for bolus administration or for continuous administration. In some embodiments, the epigenetic editor or its component(s) are introduced to target cells in the form of nucleic acid molecule(s) encoding the epigenetic editor or its component(s); accordingly, the pharmaceutical compositions herein comprise the nucleic acid molecule(s). Such nucleic acid molecule(s) may be, for example, DNA, RNA or mRNA, and/or modified nucleic acid sequence(s) (e.g., with chemical modifications, a 5' cap, or one or more 3' modifications). In some embodiments, the nucleic acid molecule(s) may be delivered as naked DNA or RNA, for instance by means of transfection or electroporation, or can be conjugated to molecules (e.g., N-acetylgalactosamine) promoting uptake by target cells. In some embodiments, the nucleic acid molecule(s) may be in nucleic acid expression vector(s), which may include expression control sequences such as promoters, enhancers, transcription signal sequences, transcription termination sequences, introns, polyadenylation signals, Kozak consensus sequences, internal ribosome entry sites (IRES), etc. Such expression control sequences are well known in the art. A vector may also comprise a sequence encoding a signal peptide (e.g., for nuclear localization, nucleolar localization, or mitochondrial localization), associated with (e.g., inserted into or fused to) a sequence coding for a protein.

Examples of vectors include, but are not limited to, plasmid vectors; viral vectors based on vaccinia virus, poliovirus, adenovirus, adeno-associated virus, SV40, herpes simplex virus, human immunodeficiency virus, retrovirus (e.g., Murine Leukemia Virus, or spleen necrosis virus, vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and other recombinant vectors. In certain embodiments, the vector is a plasmid or a viral vector. Viral particles may also be used to deliver nucleic acid molecule(s) encoding epigenetic editors or component(s) thereof as described herein. For example, "empty" viral particles can be assembled to contain any suitable cargo. Viral vectors and viral particles may also be engineered to incorporate targeting ligands to alter target tissue specificity.

In certain embodiments, an epigenetic editor as described herein or component(s) thereof are encoded by nucleic acid sequence(s) present in one or more viral vectors, or a suitable capsid protein of any viral vector. Examples of viral vectors include adeno-associated viral vectors (e.g., derived from AAV3, AAV3b, AAV4, AAV5, AAV6, AAV7, AAV8, AAV9, AAVrh8, AAV10, and/or variants thereof); retroviral vectors (e.g., Maloney murine leukemia virus, MML-V), adenoviral vectors (e.g., AD100), lentiviral vectors (e.g., HIV and FIV-based vectors), and herpesvirus vectors (e.g., HSV-2).

In some embodiments, delivery involves an adeno-associated virus (AAV) vector. AAV vector delivery may be particularly useful where the DNA-binding domain of an epigenetic editor fusion protein is a zinc finger array. Without wishing to be bound by any theory, the smaller size of zinc finger arrays compared to larger DNA-binding domains such as Cas protein domains may allow such a fusion protein to be conveniently packed in viral vectors such as an AAV vector.

Any AAV serotype, e.g., human AAV serotype, can be used for an AAV vector as described herein, including, but not limited to, AAV serotype 1 (AAV1), AAV serotype 2 (AAV2), AAV serotype 3 (AAV3), AAV serotype 4 (AAV4), AAV serotype 5 (AAV5), AAV serotype 6 (AAV6), AAV serotype 7 (AAV7), AAV serotype 8 (AAV8), AAV serotype 9 (AAV9), AAV serotype 10 (AAV10), and AAV serotype 11 (AAV11), as well as variants thereof. In some embodiments, an AAV variant has at least 90%, 91%, 92%, 93%, 94%, 95%, 96%, 97%, 98%, or 99% amino acid sequence identity to a wildtype AAV. In certain embodiments, the AAV variant may be engineered such that its capsid proteins have reduced immunogenicity or enhanced transduction ability in humans. In some instances, one or more regions of at least two different AAV serotype viruses are shuffled and reassembled to generate a chimeric variant. For example, a chimeric AAV may comprise inverted terminal repeats (ITRs) that are of a heterologous serotype compared to the serotype of the capsid. The resulting chimeric AAV can have a different antigenic reactivity or recognition compared to its parental serotypes. In some embodiments, a chimeric variant of an AAV includes amino acid sequences from 2, 3, 4, 5, or more different AAV serotypes.

Non-viral systems are also contemplated for delivery as described herein. Non-viral systems include, but are not limited to, nucleic acid transfection methods including electroporation, sonoporation, calcium phosphate transfection, microinjection, DNA biolistics, lipid-mediated transfection, transfection through heat shock, compacted DNA-mediated transfection, lipofection, cationic agent-mediated transfection, and transfection with liposomes, immunoliposomes, or cationic facial amphiphiles (CFAs). In certain embodiments, one or more mRNAs encoding epigenetic editor fusion proteins as described herein may be co-electroporated with one or more guide polynucleotides (e.g., gRNAs) as described herein. One important category of non-viral nucleic acid vectors is nanoparticles, which can be organic (e.g., lipid) or inorganic (e.g., gold). For instance, organic (e.g. lipid and/or polymer) nanoparticles can be suitable for use as delivery vehicles in certain embodiments of this disclosure.

In some embodiments, delivery is accomplished using a lipid nanoparticle (LNP). LNP compositions are typically sized on the order of micrometers or smaller and may include a lipid bilayer. In some embodiments, a LNP refers to any particle that has a diameter of less than 1000 nm, 500 nm, 250 nm, 200 nm, 150 nm, 100 nm, 75 nm, 50 nm, or 25 nm. Nanoparticle compositions encompass lipid nanoparticles (LNPs), liposomes (e.g., lipid vesicles), and lipoplexes.

An LNP as described herein may be made from cationic, anionic, or neutral lipids. In some embodiments, an LNP may comprise neutral lipids, such as the fusogenic phospholipid 1,2-Dioleoyl-sn-glycero-3-phosphoethanolamine (DOPE) or the membrane component cholesterol, as helper lipids to enhance transfection activity and nanoparticle stability. In some embodiments, an LNP may comprise hydrophobic lipids, hydrophilic lipids, or both hydrophobic and hydrophilic lipids. Any lipid or combination of lipids that are known in the art can be used to produce an LNP. The lipids may be combined in any molar ratios to produce the LNP. In some embodiments, the LNP is a liver-targeting (e.g., preferentially or specifically targeting the liver) LNP.

LNP formulations and methods of LNP delivery that can be used will be apparent to those skilled in the art based on the present disclosure and the state of the art. Non-limiting exemplary compositions and methods can be found in Shah, R., Eldridge, D., Palombo, E., and Harding, I., Lipid Nanoparticles: Production, Characterization and Stability, Springer, 2015, ISBN-13 978-3319107103; Ziegler, S., Lipid Nanoparticles: Advances in Research and Applications, Nova Science Pub., Inc, ISBN-13 978-1536186536; Mitchell, M. J., Billingsley, M. M., Haley, R. M. et al. *Engineering precision nanoparticles for drug delivery*, Nat Rev Drug Discov 20, 101-124 (2021); Hou, X., Zaks, T., Langer, R. et al. *Lipid nanoparticles for mRNA delivery*. Nat Rev Mater 6, 1078-1094 (2021); *Lipid-Nanoparticle-Based Delivery of CRISPR/Cas9 Genome-Editing Components*, Pardis Kazemian, Si-Yue Yu, Sarah B. Thomson, Alexandra Birkenshaw, Blair R. Leavitt, and Colin J. D. Ross. Molecular Pharmaceutics 2022 19 (6), 1669-1686; Cullis P R, Hope M J. *Lipid Nanoparticle Systems for Enabling Gene Therapies*, Mol Ther. 2017 Jul. 5; 25(7):1467-1475; Hatit, M. Z. C., Lokugamage, M. P., Dobrowolski, C. N. et al. *Species-dependent in vivo mRNA delivery* and *cellular responses to nanoparticles*, Nat. Nanotechnol. 17, 310-318 (2022); Lam, K., Schreiner, P., Leung, A., Stainton, P., Reid, S., Yaworski, E., Lutwyche, P. and Heyes, J. (2023), *Optimizing Lipid Nanoparticles for Delivery in Primates*, Adv. Mater; Dilliard, S. A., Siegwart, D. J. *Passive, active and endogenous organ-targeted lipid and polymer nanoparticles for delivery of genetic drugs*, Nat Rev Mater (2023); Kasiewicz, L. N., et. al., *Lipid nanoparticles incorporating a GalNAc ligand enable in vivo liver ANGPTL3 editing in wild-type and somatic LDLR knockout non-human primates*, bioRxiv 2021.11.08.467731, doi: https://doi.org/10.1101/2021.11.08.467731; Tombácz, I., et. al., *Highly efficient CD4+ T cell targeting and genetic recombination using engineered CD4'+ cell-homing mRNA-LNPs*, Molecular Therapy, Volume 29, Issue 11, 2021, 3293-3304; Cheng, Q., Wei, T., Farbiak, L. et al. *Selective organ targeting (SORT) nanoparticles for tissue-specific mRNA delivery and CRISPR-Cas gene editing*, Nat. Nanotechnol. 15, 313-320 (2020); Zhang, Y., et. al., *Lipids and Lipid Derivatives for RNA Delivery*, Chemical Reviews 2021 121 (20); Lam, K., et. al, Unsaturated, *Trialkyl Ionizable Lipids are Versatile Lipid-Nanoparticle Components for Therapeutic and Vaccine Applications, Adv. Mater.* 2023, 35; Han, X., Zhang, H., Butowska, K. et al. *An ionizable lipid toolbox for RNA delivery*, Nat Commun 12, 7233 (2021); U.S. Pat. Nos. 9,364,435; 8,058,069; 8,822,668; 8,492,359; 11,141,378; 9,518,272; 9,404,127; 9,006,417; 7,901,708; 9,005,654; 9,878,042; 9,682,139; 8,642,076; 9,593,077; 9,415,109; 9,701,623; 10,369,226; 9,999,673; 9,301,923; 10,342,761; 10,137,201; International Patent Application PCT/US2014/070882; International Publication No. WO2015199952A1; International Publication No. WO2017075531A1; International Publication No. WO2018081480A1; International Publication No. WO2016081029A1; European Application No. EP3852911A2; each of which are incorporated herein by reference in their entirety. The ordinarily skilled artisan will be able to identify an appropriate LNP and method of delivery based on the present disclosure and the state of the art. The present disclosure is not limited in this respect.

Other methods of delivery to target cells will be known to those skilled in the art and can be used with the compositions of the present disclosure.

Any type of cell may be targeted for delivery of an epigenetic editor or component(s) thereof as described herein. For example, the cells may be eukaryotic or prokaryotic. In some embodiments, the cells are mammalian (e.g., human) cells. Human cells may include, for example, hepatocytes, biliary epithelial cells (cholangiocytes), stellate cells, Kupffer cells, and liver sinusoidal endothelial cells.

In some embodiments, an epigenetic editor described herein, or component(s) thereof, are delivered to a host cell for transient expression, e.g., via a transient expression vector. Transient expression of the epigenetic editor or its component(s) may result in prolonged or permanent epigenetic modification of the target gene. For example, the epigenetic modification may be stable for at least 1, 2, 3, 4, 5, 6, 7, 8, 9, 10, 11, or 12 weeks or more; or 3, 4, 5, 6, 7, 8, 9, 10, 11, or 12 months or more, after introduction of the epigenetic editor into the host cell. The epigenetic modification may be maintained after one or more mitotic and/or meiotic events of the host cell. In particular embodiments, the epigenetic modification is maintained across generations in offspring generated or derived from the host cell.

VIII. Therapeutic Uses of Epigenetic Editors

The present disclosure also provides methods for treating or preventing a condition in a subject, comprising administering to the subject an epigenetic editor or pharmaceutical composition as described herein. The epigenetic editor may effectuate an epigenetic modification of a target polynucleotide sequence in a target gene associated with a disease, condition, or disorder in the subject, thereby modulating expression of the target gene to treat or prevent the disease, condition, or disorder. In some embodiments, the epigenetic editor reduces the expression of the target gene to an extent sufficient to achieve a desired effect, e.g., a therapeutically relevant effect such as the prevention or treatment of the disease, condition, or disorder.

In some embodiments, a subject is administered a system for modulating (e.g., repressing) expression of HBV or of an HBV gene, wherein the system comprises (1) the fusion protein(s) and, where relevant, guide polynucleotide(s) of an epigenetic editor as described herein, or (2) nucleic acid molecules encoding said fusion protein(s) and, where relevant, guide polynucleotide(s).

"Treat," "treating" and "treatment" refer to a method of alleviating or abrogating a biological disorder and/or at least one of its attendant symptoms. As used herein, to "alleviate" a disease, disorder or condition means reducing the severity and/or occurrence frequency of the symptoms of the disease, disorder, or condition. Further, references herein to "treatment" include references to curative, palliative and prophylactic treatment. In some embodiments, as compared with an equivalent untreated control, alleviating a symptom may involve reduction of the symptom by at least 3%, 5%, 10%, 20%, 40%, 50%, 60%, 80%, 90%, 95%, 98%, 99%, 99.5%, 99.9%, or 100% as measured by any standard technique.

In some embodiments, the subject may be a mammal, e.g., a human. In some embodiments, the subject is selected from a non-human primate such as chimpanzee, cynomolgus monkey, or macaque, and other apes and monkey species.

Some aspects of this disclosure provide methods comprising administering an epigenetic editing system to a subject characterized by the presence of detectable levels of HBV DNA, HBsAg, and/or HBeAg in the plasma of the subject, for example, a subject having a chronic HBV infection. In some such embodiments, the epigenetic editing system comprises a first DNA binding domain, a first DNMT domain, and a transcriptional repressor domain or one or more nucleic acid molecules encoding the same, wherein the first DNA binding domain binds a first target region of an HBV gene or genome, and the administering results in a reduction of the level of HBV DNA, the level of HBsAg, and/or the level of HBsAg in the plasma of the subject, and the reduction of the level of HBV DNA, of the level of HBsAg, and/or of the level of HBsAg in the plasma of the subject, is at least 90% (a 1-log reduction) compared to the respective level observed or observable in the plasma of the subject prior to the administering, and the 1-log reduction is maintained for at least 14 days after the administering. In some embodiments, the reduction of the level of HBV DNA in the plasma of the subject is at least 90% (a 1-log reduction). In some embodiments, the reduction of the level of HBV DNA in the plasma of the subject is at least 99% (a 2-log reduction). In some embodiments, the reduction of the level of HBsAg in the plasma of the subject is at least 90% (a 1-log reduction). In some embodiments, the reduction of the level of HBsAg in the plasma of the subject is at least 99% (a 2-log reduction). In some embodiments, the reduction of the level of HBeAg in the plasma of the subject is at least 90% (a 1-log reduction). In some embodiments, the reduction of the level of HBeAg in the plasma of the subject is at least 99% (a 2-log reduction). In some embodiments, the reduction is maintained for at least 21 days. In some embodiments, the reduction is maintained for at least 28 days. In some embodiments, the reduction is maintained for at least 35 days. In some embodiments, the reduction is maintained for at least 42 days. In some embodiments, the reduction is maintained for at least 56 days. In some embodiments, the reduction is maintained for at least 70 days. In some embodiments, the reduction is maintained for at least 84 days. In some embodiments, the reduction is maintained for at least 112 days. In some embodiments, the reduction is maintained for at least 140 days. In some embodiments, the reduction is maintained for at least 168 days. In some embodiments, the reduction is maintained for at least 6 months. In some embodiments, the reduction is maintained for at least 9 months. In some embodiments, the reduction is maintained for at least 12 months. In some embodiments, the reduction is maintained for at least 24 months. In some embodiments, the HBV genome comprises HBV genotype A. In some embodiments, the HBV genome comprises HBV genotype B. In some embodiments, the HBV genome comprises HBV genotype C. In some embodiments, the HBV genome comprises, HBV genotype D. In some embodiments, the HBV genome comprises HBV genotype E. In some embodiments, the HBV genome comprises HBV genotype F. In some embodiments, the HBV genome comprises HBV genotype G. In some embodiments, the HBV genome comprises HBV genotype H. In some embodiments, the HBV genome comprises a sequence with at least 80%, at least 90%, at least 95%, at least 99%, or greater than 99% sequence identity to an HBV genome sequence provided herein. In some embodiments, the first target region is located in a region of the HBV genome within nucleotides 0-303 of an HBV genome provided herein. In some embodiments, the first target region is located within nucleotides 0-303 of SEQ ID NO: 1082. In some embodiments, the first target region is located within nucleotides 0-303 of SEQ ID NO: 1083. In some embodiments, the first target region is located in a region of the HBV genome within nucleotides 1000-2448 of an HBV genome provided herein. In some embodiments, the first target region is located within nucleotides 1000-2448 of SEQ ID NO: 1082. In some embodiments, the first target region is located within nucleotides 1000-2448 of SEQ ID NO: 1083. In some embodiments, the first target region is located in a region of the HBV genome within nucleotides 2802-3182 of an HBV genome provided herein. In some embodiments, the first target region is located within nucleotides 2802-3182 of SEQ ID NO: 1082. In some embodiments, the first target region is located within nucleotides 2802-3182 of SEQ ID NO: 1083. In some embodiments, the first target region of the HBV genome is located in an HBV CpG island (CGI). In some embodiments, the CGI is an HBV canonical CGI. In some embodiments, the CGI is canonical CGI-I. In some embodiments, CGI is canonical CGI-I of HBV genotype D. In some embodiments, CGI-I spans nucleotides 186-288 of SEQ ID NO: 1082In some embodiments, CGI-I spans nucleotides 186-288 of SEQ ID NO: 1083In some embodiments, the CGI is canonical CGI-II. In some embodiments, the CGI is canonical CGI-II HBV genotype D. In some embodiments, the CGI is CGI II spans nucleotides 1,217-1,670 of SEQ ID NO: 1082. In some embodiments, the CGI is CGI II spans nucleotides 1,217-1,670 of SEQ ID NO: 1083. In some embodiments, the CGI is canonical CGI-III. In some embodiments, the CGI is canonical CGI-III HBV genotype D. In some embodiments, the CGI is CGI-III spans nucleotides 2,282-2,448 of SEQ ID NO: 1082. In some embodiments, the CGI is CGI-III spans nucleotides 2,282-2,448 of SEQ ID NO: 1083. In some embodiments, the first target region of the HBV genome is located in a promotor. In some embodiments, the first target region of the HBV genome is located in the sp1 promoter. In some embodiments, the first target region of the HBV genome is located in sp2 promoter. In some embodiments, the first target region of the HBV genome is located in cp promoter. In some embodiments, the first target region of the HBV genome is located in xp promoter. In some embodiments, the first target region of the HBV genome is located in an enhancer region. In some embodiments, the first target region of the HBV genome is located in Enh I. In some embodiments, the first target region of the HBV genome is located in Enh II. In some embodiments, the first target region of the HBV genome is located in a section of the HBV genome that encodes a transcript. In some embodiments, the first target region of the HBV genome is located in a section of the HBV genome that encodes a pgRNA transcript. In some embodiments, the first target region of the HBV genome is located in a section of the HBV genome that encodes a preCore RNA transcript. In some embodiments, the first target region of the HBV genome is located in a section of the HBV genome that encodes a preS RNA transcript. In some embodiments, the first target region of the HBV genome is located in a section of the HBV genome that encodes an S RNA transcript. In some embodiments, the first target region of the HBV genome is located in a section of the HBV genome that encodes an HBx RNA transcript. In some embodiments, the first target region of the HBV genome is within 1000, 900, 800, 700, 600, 500, 400, 300, 200, or 100 base pairs (bp) of an HBV transcription start site (TSS). In some embodiments, the TSS is a pg RNA TSS. In some embodiments, the first target region is within 600, within 500, within 400, within 300, within 200, or within 100 base pairs of the pg RNA TSS. In some embodiments, the pg RNA TSS is located at nucleotide 1820 of SEQ ID NO: 1082 or at nucleotide 1820 of SEQ ID NO: 1083. In some embodiments, the first target region is within 600 base pairs of nucleotide 1820 in SEQ ID NO: 1082. In some embodiments, the first target region is within 600 base pairs of nucleotide 1820 in SEQ ID NO: 1083. In some embodiments, the first target region is within 500 base pairs of nucleotide 1820 in SEQ ID NO: 1082. In some embodiments, the first target region is within 500 base pairs of nucleotide 1820 in SEQ ID NO: 1083. In some embodiments, the first target region is within 400 base pairs of nucleotide 1820 in SEQ ID NO: 1082. In some embodiments, the first target region is within 400 base pairs of nucleotide 1820 in SEQ ID NO: 1083. In some embodiments, the first target region is within 300 base pairs of nucleotide 1820 in SEQ ID NO: 1082. In some embodiments, the first target region is within 300 base pairs of nucleotide 1820 in SEQ ID NO: 1083. In some embodiments, the first target region is within 200 base pairs of nucleotide 1820 in SEQ ID NO: 1082. In some embodiments, the first target region is within 200 base pairs of nucleotide 1820 in SEQ ID NO: 1083. In some embodiments, the first target region is within 100 base pairs of nucleotide 1820 in SEQ ID NO: 1082. In some embodiments, the first target region is within 100 base pairs of nucleotide 1820 in SEQ ID NO: 1083. In some embodiments, the TSS is a preC RNA TSS. In some embodiments, the first target region is within 600, within 500, within 400, within 300, within 200, or within 100 base pairs of the preC RNA TSS. In some embodiments, the preC RNA TSS is located at nucleotide 1791 of SEQ ID NO: 1082 or at nucleotide 1791 of SEQ ID NO: 1083. In some embodiments, the first target region is within 600 base pairs of nucleotide 1791 in SEQ ID NO: 1082. In some embodiments, the first target region is within 600 base pairs of nucleotide 1791 in SEQ ID NO: 1083. In some embodiments, the first target region is within 500 base pairs of nucleotide 1791 in SEQ ID NO: 1082. In some embodiments, the first target region is within 500 base pairs of nucleotide 1791 in SEQ ID NO: 1083. In some embodiments, the first target region is within 400 base pairs of nucleotide 1791 in SEQ ID NO: 1082. In some embodiments, the first target region is within 400 base pairs of nucleotide 1791 in SEQ ID NO: 1083. In some embodiments, the first target region is within 300 base pairs of nucleotide 1791 in SEQ ID NO: 1082. In some embodiments, the first target region is within 300 base pairs of nucleotide 1791 in SEQ ID NO: 1083. In some embodiments, the first target region is within 200 base pairs of nucleotide 1791 in SEQ ID NO: 1082. In some embodiments, the first target region is within 200 base pairs of nucleotide 1791 in SEQ ID NO: 1083. In some embodiments, the first target region is within 100 base pairs of nucleotide 1791 in SEQ ID NO: 1082. In some embodiments, the first target region is within 100 base pairs of nucleotide 1791 in SEQ ID NO: 1083. In some embodiments, the TSS is a preS2 RNA TSS. In some embodiments, the first target region is within 600, within 500, within 400, within 300, within 200, or within 100 base pairs of the preS2 RNA TSS. In some embodiments, the preS2 RNA TSS is located at nucleotide 3159 of SEQ ID NO: 1082 or at nucleotide 3159 of SEQ ID NO: 1083. In some embodiments, the first target region is within 600 base pairs of nucleotide 3159 in SEQ ID NO: 1082. In some embodiments, the first target region is within 600 base pairs of nucleotide 3159 in SEQ ID NO: 1083. In some embodiments, the first target region is within 500 base pairs of nucleotide 3159 in SEQ ID NO: 1082. In some embodiments, the first target region is within 500 base pairs of nucleotide 3159 in SEQ ID NO: 1083. In some embodiments, the first target region is within 400 base pairs of nucleotide 3159 in SEQ ID NO: 1082. In some embodiments, the first target region is within 400 base pairs of nucleotide 3159 in SEQ ID NO: 1083. In some embodiments, the first target region is within 300 base pairs of nucleotide 3159 in SEQ ID NO: 1082. In some embodiments, the first target region is within 300 base pairs of nucleotide 3159 in SEQ ID NO: 1083. In some embodiments, the first target region is within 200 base pairs of nucleotide 3159 in SEQ ID NO: 1082. In some embodiments, the first target region is within 200 base pairs of nucleotide 3159 in SEQ ID NO: 1083. In some embodiments, the first target region is within 100 base pairs of nucleotide 3159 in SEQ ID NO: 1082. In some embodiments, the first target region is within 100 base pairs of nucleotide 3159 in SEQ ID NO: 1083. In some embodiments, the TSS is an HBx RNA TSSs. In some embodiments, the first target region is within 600, within 500, within 400, within 300, within 200, or within 100 base pairs of the HBx RNA TSS. In some embodiments, the HBx RNA TSS is located at a nucleotide within the sequence of nucleotides 1243-1338 of SEQ ID NO: 1082 or nucleotides 1243-1338 of SEQ ID NO: 1083. In some embodiments, the first target region is within 600 base pairs of nucleotide 1243 in SEQ ID NO: 1082. In some embodiments, the first target region is within 600 base pairs of nucleotide 1243 in SEQ ID NO: 1083. In some embodiments, the first target region is within 500 base pairs of nucleotide 1243 in SEQ ID NO: 1082. In some embodiments, the first target region is within 500 base pairs of nucleotide 1243 in SEQ ID NO: 1083. In some embodiments, the first target region is within 400 base pairs of nucleotide 1243 in SEQ ID NO: 1082. In some embodiments, the first target region is within 400 base pairs of nucleotide 1243 in SEQ ID NO: 1083. In some embodiments, the first target region is within 300 base pairs of nucleotide 1243 in SEQ ID NO: 1082. In some embodiments, the first target region is within 300 base pairs of nucleotide 1243 in SEQ ID NO: 1083. In some embodiments, the first target region is within 200 base pairs of nucleotide 1243 in SEQ ID NO: 1082. In some embodiments, the first target region is within 200 base pairs of nucleotide 1243 in SEQ ID NO: 1083. In some embodiments, the first target region is within 100 base pairs of nucleotide 1243 in SEQ ID NO: 1082. In some embodiments, the first target region is within 100 base pairs of nucleotide 1243 in SEQ ID NO: 1083. In some embodiments, the first target region is within 600 base pairs of nucleotide 1338 in SEQ ID NO: 1083. In some embodiments, the first target region is within 500 base pairs of nucleotide 1338 in SEQ ID NO: 1082. In some embodiments, the first target region is within 500 base pairs of nucleotide 1338 in SEQ ID NO: 1083. In some embodiments, first target region is within 400 base pairs of nucleotide 1338 in SEQ ID NO: 1082. In some embodiments, the first target region is within 400 base pairs of nucleotide 1338 in SEQ ID NO: 1083. In some embodiments, the first target region is within 300 base pairs of nucleotide 1338 in SEQ ID NO: 1082. In some embodiments, the first target region is within 300 base pairs of nucleotide 1338 in SEQ ID NO: 1083. In some embodiments, the first target region is within 200 base pairs of nucleotide 1338 in SEQ ID NO: 1082. In some embodiments, the first target region is within 200 base pairs of nucleotide 1338 in SEQ ID NO: 1083. In some embodiments, the first target region is within 100 base pairs of nucleotide 1338 in SEQ ID NO: 1082. In some embodiments, the first target region is within 100 base pairs of nucleotide 1338 in SEQ ID NO: 1083. In some embodiments, the reduction is a reduction in the number of HBV viral episomes. In some embodiments, the reduction is a reduction in the number of cccDNA genomes. In some embodiments, the reduction is a reduction in total HBV DNA. In some embodiments, the reduction is a reduction in the replication of the HBV genome. In some embodiments, the reduction is a reduction in a level of expression of a protein product encoded by the HBV genome. In some embodiments, the reduction is a reduction in a level of HBsAg. In some embodiments, the reduction is a reduction in a level of HBeAg. In some embodiments, the reduction is a reduction of total HBV DNA of at least 70%, at least 80%, at least 90%, at least 95%, at least 99%, or at least 99.9%, and the reduction is maintained for at least 14 days after the contacting or the administering. In some embodiments, the reduction is a reduction of HBeAg of at least 70%, at least 80%, at least 90%, at least 95%, at least 99%, or at least 99.9%, and the reduction is maintained for at least 14 days after the contacting or the administering. In some embodiments, the reduction is a reduction of HBsAg of at least 70%, at least 80%, at least 90%, at least 95%, at least 99%, or at least 99.9%, and the reduction is maintained at or below that level for at least 14 days after the contacting or the administering. In some embodiments, the reduction is a reduction of at least 90%. In some embodiments, the reduction is a reduction of at least 95%. In some embodiments, the reduction is a reduction of at least 99%. In some embodiments, the reduction is a reduction of at least 99.9%. In some embodiments, the reduction is maintained for at least 14 days after the contacting or the administering. In some embodiments, the reduction is maintained for at least 21 days. In some embodiments, the reduction is maintained for at least 28 days. In some embodiments, the reduction is maintained for at least 35 days. In some embodiments, the reduction is maintained for at least 42 days. In some embodiments, the reduction is maintained for at least 56 days. In some embodiments, the reduction is maintained for at least 70 days. In some embodiments, the reduction is maintained for at least 84 days. In some embodiments, the reduction is maintained for at least 112 days. In some embodiments, the reduction is maintained for at least 140 days. In some embodiments, the reduction is maintained for at least 168 days. In some embodiments, the reduction is maintained for at least 6 months. In some embodiments, the reduction is maintained for at least 7 months. In some embodiments, the reduction is maintained for at least 8 months. In some embodiments, the reduction is maintained for at least 9 months. In some embodiments, the reduction is maintained for at least 12 months. In some embodiments, the reduction is maintained for at least 18 months. In some embodiments, the reduction is maintained for at least 24 months. In some embodiments, the epigenetic editing system is administered as a monotherapy. Accordingly, in some embodiments, the method does not comprise administering a nucleoside or nucleotide analog (NUC) to the subject. In some embodiments, the method further comprises administering a NUC to the subject. In some embodiments, the first DNA binding domain comprises a CRISPR-Cas protein. In some embodiments, the epigenetic editing system further comprises a first guide RNA (gRNA) that comprises a region complementary to a strand of the first target region. In some embodiments, the gRNA comprises a sequence selected from a gRNA provided herein, and preferably the gRNA comprises a sequence provided in Table 12 or 13. In some embodiments, the first DNA binding domain comprises a zinc-finger protein. In some embodiments, the zinc-finger protein comprises a zinc-finger motif with a sequence selected from any zinc finger or zinc finger motif provided herein, e.g., in Table 1 or Table 18. In some embodiments, the zinc-finger protein comprises a sequence of any of the zinc finger epigenetic repressors provided herein. In some embodiments, the transcriptional repressor domain comprises ZIM3. In some embodiments, the first DNMT domain is a DNMT3A domain or a DNMT3L domain. In some embodiments, the first DNMT domain comprises a sequence of a DNMT domain provided herein. In some embodiments, the epigenetic editing system comprises the fusion protein provided in SEQ ID NO: 1248 or the fusion protein provided in SEQ ID NO: 1252 and at least one guide RNA provided as gRNA #003, gRNA #007, gRNA #008, gRNA #009, gRNA #011, or gRNA #015 herein. Some aspects of this disclosure provide epigenetic editing systems for use in the methods described herein. In some embodiments, the epigenetic editing system comprises a fusion protein or a nucleic acid encoding the fusion protein, and the fusion protein comprises: (a) a DNA-binding domain that binds a target region of a HBV gene or genome, (b) a first DNA methyltransferase (DNMT) domain, and (c) a transcriptional repressor domain. In some embodiments, the fusion protein comprises a sequence of a fusion protein provided herein. In some embodiments, the DNA-binding domain is a CRISPR-Cas DNA binding domain, and the epigenetic editing system comprises at least gRNA provided herein. In some embodiments, the epigenetic editing system comprises the fusion protein provided in SEQ ID NO: 1248 or the fusion protein provided in SEQ ID NO: 1252 and at least one guide RNA provided as gRNA #003, gRNA #007, gRNA #008, gRNA #009, gRNA #011, or gRNA #015 herein.

In some embodiments, the subject is a mammalian subject having, or having been diagnosed with, a Hepatitis B virus (HBV) infection. In some embodiments, the subject is a mammalian subject having, or having been diagnosed with, a Hepatitis D virus infection.

In some embodiments, the subject is a mammalian subject, for example, a human subject, having, or having been diagnosed with, a Hepatitis B virus (HBV) infection. In some embodiments, the subject is a mammalian subject, for example, a human subject, having, or having been diagnosed with Hepatitis B In some embodiments, the subject is a mammalian subject, for example, a human subject, having, or having been diagnosed with, a Hepatitis D virus infection. In some embodiments, a patient to be treated with an epigenetic editor of the present disclosure has received prior treatment for the condition to be treated (e.g., an HBV and/or HDV infection, or Hepatitis B). In other embodiments, the patient has not received such prior treatment. In some embodiments, the patient has failed on (or is refractory to) a prior treatment for the condition (e.g., a prior HBV treatment).

In some embodiments, contacting the HBV gene or genome or a cell with an epigenetic editor as described herein results in a reduction of: number of HBV viral episomes, replication of the HBV gene or genome, or expression of a protein product encoded by the HBV gene or genome. In some embodiments, the reduction is at least about 20%, at least about 30%, at least about 40%, at least about 50%, at least about 60%, at least about 70%, at least about 80%, or at least about 90% compared to contacting the HBV gene or genome or the cell with a suitable control or without contacting the HBV gene or genome or the cell with the epigenetic editor described herein. In some embodiments, the reduction is maintained for at least 6 days, 19 days, 27 days, 42 days, or 168 days. In some embodiments, the protein product comprises a HBe antigen or a HBs antigen.

In some embodiments, administering to the subject an epigenetic editor or pharmaceutical composition as described herein results in a reduction of: number of HBV viral episomes, replication of the HBV gene or genome, or expression of a protein product encoded by the HBV gene or genome. In some embodiments, the reduction is at least about 20%, at least about 30%, at least about 40%, at least about 50%, at least about 60%, at least about 70%, at least about 80%, or at least about 90% compared to administering a suitable control or without administering the epigenetic editor or pharmaceutical composition described herein. In some embodiments, the reduction is maintained for at least 6 days, 19 days, 27 days, 42 days, or 168 days. In some embodiments, the protein product comprises a HBe antigen or a HBs antigen.

An epigenetic editor of the present disclosure may be administered in a therapeutically effective amount to a patient with a condition described herein. "Therapeutically effective amount," as used herein, refers to an amount of the therapeutic agent being administered that will relieve to some extent one or more of the symptoms of the disorder being treated, and/or result in clinical endpoint(s) desired by healthcare professionals. An effective amount for therapy may be measured by its ability to stabilize disease progression and/or ameliorate symptoms in a patient, and preferably to reverse disease progression. The ability of an epigenetic editor of the present disclosure to reduce or silence HBV expression may be evaluated by in vitro assays, e.g., as described herein, as well as in suitable animal models that are predictive of the efficacy in humans. Suitable dosage regimens will be selected in order to provide an optimum therapeutic response in each particular situation, for example, administered as a single bolus or as a continuous infusion, and with possible adjustment of the dosage as indicated by the exigencies of each case.

An epigenetic editor of the present disclosure may be administered without additional therapeutic treatments, i.e., as a stand-alone therapy (monotherapy). Alternatively, treatment with an epigenetic editor of the present disclosure may include at least one additional therapeutic treatment (combination therapy). In some embodiments, the additional therapeutic agent is any known in the art to treat an HBV infection. The current standard therapy for HBV employs nucleoside/nucleotide analogs (NUCs) and interferon (IFN). NUCs are viral polymerase and reverse transcriptase inhibitors that can efficiently suppress HBV viral replication, resulting in rapid HBV DNA reduction. NUCs do not directly target HBV cccDNA transcription, but NUC treatment of human HBV patients has been reported to reduce plasma HBV biomarkers such as HBeAg and HBsAg tp some extent. Prolonged therapy with NUCs is frequently associated with the pathogen developing a resistance to the treatment, but some NUCs have been reported to be able to achieve long-term viral suppression and halt disease progression. IFN-based therapy has both direct antiviral and immunomodulatory effects, and has been reported to prevent the formation of replication-competent pregenomic RNA-containing HBV capsids, or otherwise accelerates their degradation, thereby inhibiting HBV replication. See, e.g., Su et al., Improving clinical outcomes of chronic hepatitis B virus infection. Expert Rev Gastroenterol Hepatol. 2015; 9:141-154; European Association for the Study of the Liver. EASL clinical practice guidelines: management of chronic hepatitis B virus infection. J Hepatol. 2012; 57:167-185; Wieland et al., Intrahepatic induction of alpha/beta interferon eliminates viral RNA-containing capsids in hepatitis B virus transgenic mice. J Virol. 2000; and Wieland et al., Interferon prevents formation of replication-competent hepatitis B virus RNA-containing nucleocapsids. Proc Natl Acad Sci USA. 2005; 102:9913-9917, the entire contents of each of which are incorporated herein by reference.

In some embodiments, an epigenetic editor of the present disclosure is administered to a subject in need thereof, e.g., a subject having an HBV infection, without additional therapeutic treatment, e.g., without the co-administration of NUCs or IFN, or any other therapeutic treatment aimed at HBV, i.e., as a stand-alone therapy (monotherapy). In some such embodiments, a durable reduction of an HBV biomarker (e.g., as measured as the plasma level of HBV DNA, HBsAg, or HBeAG) by at least 20%, at least 30%, at least 40%, at least 50%, at least 60%, at least 70%, at least 80%, at least 90%, at least 95%, at least 99%, at least 99.9%, or more, is achieved over a time period of at least 14 days, at least 21 days, at least 28 days, at least 35 days, at least 42 days, at least 56 days, at least 70 days, at least 84 days, at least 112 days, at least 140 days, at least 168 days, at least 6 months, at least 7 months, at least 8 months, at least 9 months, at least 10 months, at least 11 months, at least 12 months, at least 18 months, at least 24 months, or longer, after a single-dose administration of the epigenetic editor to the subject.

In some embodiments, an epigenetic editor of the present disclosure is administered to a subject in need thereof, e.g., a subject having an HBV infection, in combination with (i.e., in temporal proximity) at least one additional HBV therapeutics, e.g., with NUCs and/or IFN therapeutics, or with any other therapeutic treatment aimed at HBV, i.e., as a combination therapy (monotherapy). In some such embodiments, a durable reduction of an HBV biomarker (e.g., as measured as the plasma level of HBV DNA, HBsAg, or HBeAG) by at least 20%, at least 30%, at least 40%, at least 50%, at least 60%, at least 70%, at least 80%, at least 90%, at least 95%, at least 99%, at least 99.9%, or more, is achieved over a time period of at least 14 days, at least 21 days, at least 28 days, at least 35 days, at least 42 days, at least 56 days, at least 70 days, at least 84 days, at least 112 days, at least 140 days, at least 168 days, at least 6 months, at least 7 months, at least 8 months, at least 9 months, at least 10 months, at least 11 months, at least 12 months, at least 18 months, at least 24 months, or longer.

An epigenetic editor of the present disclosure may be administered without additional therapeutic treatments, i.e., as a stand-alone therapy (monotherapy). Alternatively, treatment with an epigenetic editor of the present disclosure may include at least one additional therapeutic treatment (combination therapy). In some embodiments, the additional therapeutic agent is any known in the art to HBV and/or HDV. In some embodiments, therapeutic agents include, but are not limited to, antivirals, such as entecavir, tenofovir, lamivudine, telvivudine, bictegravir, emtricitabine, or defovir, as well as immune modulators, such as pegylated interferon and interferon alpha.

The epigenetic editors or components thereof (or nucleic acid molecules encoding the epigenetic editors or components thereof) of the present disclosure may be administered by any method accepted in the art (e.g., parenterally, intravenously, intradermally, or intramuscularly).

The epigenetic editors or components thereof (or nucleic acid molecules encoding the epigenetic editors or components thereof) of the present disclosure may be administered to a subject once, twice, three times, or 4, 5, 6, 7, 8, 9, 10, or more times. In some embodiments, the one, two, three, or 4, 5, 6, 7, 8, 9, 10, or more administrations of epigenetic editors or components thereof (or nucleic acid molecules encoding the epigenetic editors or components thereof) are in temporal proximity, e.g., within 1 day, 2 days, 3 days, 4 days, 5 days, 6 days, 1 week, 2 weeks, 4 weeks, 1 month or two months of each other. In some embodiments, a subject is re-dosed with the epigenetic editors or components thereof (or nucleic acid molecules encoding the epigenetic editors or components thereof) of the present disclosure for at least one more time after an initial dose. In some cases, a subject is administered with a subsequent dose of the epigenetic editors or components thereof (or nucleic acid molecules encoding the epigenetic editors or components thereof) of the present disclosure, which target a different DNA region of the HBV genome than the DNA region of the HBV genome that is targeted by the epigenetic editors or components thereof that the subject receives at the initial dose. In some cases, a subject is administered with multiple doses (e.g., 2, 3, 4, 5, 6, 7, 8, 9, 10, or more) of the same epigenetic editors or components thereof (or nucleic acid molecules encoding the epigenetic editors or components thereof) of the present disclosure. In some cases, a subject is administered with a single dose of different epigenetic editors or components thereof (or nucleic acid molecules encoding the epigenetic editors or components thereof) of the present disclosure, at least two of which target different DNA regions of the HBV genome. In some cases, a subject is administered with multiple doses (e.g., 2, 3, 4, 5, 6, 7, 8, 9, 10, or more) of different epigenetic editors or components thereof (or nucleic acid molecules encoding the epigenetic editors or components thereof) of the present disclosure, at least two of which target different DNA regions of the HBV genome. In some embodiments, redosing of the epigenetic editors or components thereof (or nucleic acid molecules encoding the epigenetic editors or components thereof) of the present disclosure has a better therapeutic efficacy than a single dose of the same, e.g., more potent suppression of HBV replication, or more profound reduction in HBV DNA and/or HBV antigens (e.g., HBsAg, HBeAg, and/or HBV core antigen (HBcAg)) present in the subject, e.g., in the circulation system and/or liver of the subject.

XII. Definitions

The term "nucleic acid" as used herein refers to any oligonucleotide or polynucleotide containing nucleotides (e.g., deoxyribonucleotides or ribonucleotides) in either single- or double-strand form, and includes DNA and RNA. "Nucleotides" contain a sugar deoxyribose (DNA) or ribose (RNA), a base, and a phosphate group, and are linked together through the phosphate groups. "Bases" include purines and pyrimidines, which include natural compounds such as adenine, thymine, guanine, cytosine, uracil, inosine, and natural analogs; as well as synthetic derivatives of purines and pyrimidines, which include, but are not limited to, modified versions which place new reactive groups such as amines, alcohols, thiols, carboxylates, alkylhalides, etc. Nucleic acids may contain known nucleotide analogs and/or modified backbone residues or linkages, which may be synthetic, naturally occurring, and non-naturally occurring. Such nucleotide analogs, modified residues, and modified linkages are well known in the art, and may provide a nucleic acid molecule with enhanced cellular uptake, reduced immunogenicity, and/or increased stability in the presence of nucleases.

As used herein, an "isolated" or "purified" nucleic acid molecule is a nucleic acid molecule that exists apart from its native environment. For example, an "isolated" or "purified" nucleic acid molecule (1) has been separated away from the nucleic acids of the genomic DNA or cellular RNA of its source of origin; and/or (2) does not occur in nature. In some embodiments, an "isolated" or "purified" nucleic acid molecule is a recombinant nucleic acid molecule.

It will be understood that in addition to the specific proteins and nucleic acid molecules mentioned herein, the present disclosure also contemplates the use of variants, derivatives, homologs, and fragments thereof. A variant of any given sequence may have the specific sequence of residues (whether amino acid or nucleic acid residues) modified in such a manner that the polypeptide or polynucleotide in question substantially retains at least one of its endogenous functions. A variant sequence can be obtained by addition, deletion, substitution, modification, replacement and/or variation of at least one residue present in the naturally-occurring sequence (in some embodiments, no more than 1, 2, 3, 4, 5, 6, 7, 8, 9, 10, 15, or 20 residues). For specific proteins described herein (e.g., KRAB, dCas9, DNMT3A, and DNMT3L proteins described herein), the present disclosure also contemplates any of the protein's naturally occurring forms, or variants or homologs that retain at least one of its endogenous functions (e.g., at least 50%, 60%, 70%, 80%, 90%, 85%, 96%, 97%, 98%, or 99% of its function as compared to the specific protein described).

As used herein, a homologue of any polypeptide or nucleic acid sequence contemplated herein includes sequences having a certain homology with the wildtype amino acid and nucleic sequence. A homologous sequence may include a sequence, e.g. an amino acid sequence which may be at least 50%, 55%, 65%, 75%, 85%, 90%, 91%, 92%<93%, 94%, 95%, 96%, 97%, 98%, or 99% identical to the subject sequence. The term "percent identical" in the context of amino acid or nucleotide sequences refers to the percent of residues in two sequences that are the same when aligned for maximum correspondence. In some embodiments, the length of a reference sequence aligned for comparison purposes is at least 30%, (e.g., at least 40, 50, 60, 70, 80, or 90%, or 100%) of the reference sequence. Sequence identity may be measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. In an exemplary approach to determining the degree of identity, a BLAST program may be used, with a probability score between e-3 and e-100 indicating a closely related sequence.

The percent identity of two nucleotide or polypeptide sequences is determined by, e.g., BLAST® using default parameters (available at the U.S. National Library of Medicine's National Center for Biotechnology Information website). In some embodiments, the length of a reference sequence aligned for comparison purposes is at least 30%, (e.g., at least 40, 50, 60, 70, 80, or 90%) of the reference sequence.

It will be understood that the numbering of the specific positions or residues in polypeptide sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

The term "modulate" or "alter" refers to a change in the quantity, degree, or extent of a function. For example, an epigenetic editor as described herein may modulate the activity of a promoter sequence by binding to a motif within the promoter, thereby inducing, enhancing, or suppressing transcription of a gene operatively linked to the promoter sequence. As other examples, an epigenetic editor as described herein may block RNA polymerase from transcribing a gene, or may inhibit translation of an mRNA transcript. The terms "inhibit," "repress," "suppress," "silence" and the like, when used in reference to an epigenetic editor or a component thereof as described herein, refers to decreasing or preventing the activity (e.g., transcription) of a nucleic acid sequence (e.g., a target gene) or protein relative to the activity of the nucleic acid sequence or protein in the absence of the epigenetic editor or component thereof. The term may include partially or totally blocking activity, or preventing or delaying activity. The inhibited activity may be, e.g., 10%, 20%, 30%, 40%, 50%, 60%, 70%, 75%, 80%, 85%, 90%, 91%, 92%, 93%, 94%, 95%, 96%, 97%, 98%, 99%, or 99.9% less than that of a control, or may be, e.g., at least 1.5-fold, 2-fold, 3-fold, 4-fold, 5-fold, or 10-fold less than that of a control. For example, in some embodiments, the inhibited activity (e.g., the transcription or expression of an HBV target gene, or the level of an HBV biomarker) may be at least 70% less than that of a control. In some embodiments, the inhibited activity may be at least 80% less than that of a control. In some embodiments, the inhibited activity may be at least 90% less than that of a control (1 log reduction). In some embodiments, the inhibited activity may be at least 91% less than that of a control. In some embodiments, the inhibited activity may be at least 92% less than that of a control. In some embodiments, the inhibited activity may be at least 93% less than that of a control. In some embodiments, the inhibited activity may be at least 94% less than that of a control. In some embodiments, the inhibited activity may be at least 95% less than that of a control. In some embodiments, the inhibited activity may be at least 96% less than that of a control. In some embodiments, the inhibited activity may be at least 97% less than that of a control. In some embodiments, the inhibited activity may be at least 98% less than that of a control. In some embodiments, the inhibited activity may be at least 99% less than that of a control (2 log reduction). In some embodiments, the inhibited activity may be at least 99.9% less than that of a control (3 log reduction).

The term "about" or "approximately" means within an acceptable error range for the particular value as determined by one of ordinary skill in the art, which will depend in part on how the value is measured or determined, e.g., the limitations of the measurement system. For example, "about" can mean within one or more than one standard deviation, per the practice in the given value. Where particular values are described in the application and claims, unless otherwise stated, the term "about" should be assumed to mean an acceptable error range for the particular value.

Ranges provided herein are understood to be shorthand for all of the values within the range. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50, as well as all intervening decimal values between the aforementioned integers such as, for example, 1.1, 1.2, 1.3, 1.4, 1.5, 1.6, 1.7, 1.8, and 1.9. With respect to sub-ranges, "nested sub-ranges" that extend from either end point of the range are specifically contemplated. For example, a nested sub-range of an exemplary range of 1 to 50 may comprise 1 to 10, 1 to 20, 1 to 30, and 1 to 40 in one direction, or 50 to 40, 50 to 30, 50 to 20, and 50 to 10 in the other direction.

Unless otherwise defined herein, scientific and technical terms used in connection with the present disclosure shall have the meanings that are commonly understood by those of ordinary skill in the art. Exemplary methods and materials are described below, although methods and materials similar or equivalent to those described herein can also be used in the practice or testing of the present disclosure. In case of conflict, the present specification, including definitions, will control. Further, unless otherwise required by context, singular terms shall include pluralities and plural terms shall include the singular. Throughout this specification and embodiments, the words "have" and "comprise," or variations such as "has," "having," "comprises," or "comprising," will be understood to imply the inclusion of a stated integer or group of integers but not the exclusion of any other integer or group of integers. The recitation of a listing of elements herein includes any of the elements singly or in any combination. The recitation of an embodiment herein includes that embodiment as a single embodiment, or in combination with any other embodiment(s) herein. All publications, patents, patent applications, and other references mentioned herein, including, where applicable, any supplementary information, are incorporated by reference in their entirety. To the extent that references incorporated by reference contradict the disclosure contained in the specification, the specification is intended to supersede and/or take precedence over any such contradictory material. Although a number of documents are cited herein, this citation does not constitute an admission that any of these documents forms part of the common general knowledge in the art.

Listings of Exemplary Embodiments

In order that the present disclosure may be better understood, the following listings of exemplary embodiments is provided. This listing is for purposes of illustration of certain embodiments only. Additional embodiments will be apparent to the skilled artisan based on the present disclosure, and the listing below is not to be construed as limiting the scope of the present disclosure.

LISTING #1 of Exemplary Embodiments:

1. A method of modifying an epigenetic state of a hepatitis B virus (HBV) gene or genome, comprising contacting the HBV gene or genome with an epigenetic editing system,
   wherein the epigenetic editing system comprises
   a first DNA binding domain, a first DNMT domain, and a transcriptional repressor domain or one or more nucleic acid molecules encoding the same,
   wherein the first DNA binding domain binds a first target region of the HBV gene or genome, and
   wherein the contacting results in a reduction of
   number of HBV viral episomes,
   replication of the HBV gene or genome, and/or
   expression of a protein product encoded by the HBV gene or genome, wherein the reduction is at least about 50%, and preferably wherein the reduction is at least 60%, at least 70%, at least 80%, at least 90%, at least 95%, at least 99%, or greater than 99%, compared to contacting the HBV gene or genome with a suitable control.

2. A method of treating an HBV infection in a subject comprising administering an epigenetic editing system to the subject,
   wherein the epigenetic editing system comprises
   a first DNA binding domain, a first DNMT domain, and a transcriptional repressor domain or one or more nucleic acid molecules encoding thereof,
   wherein the first DNA binding domain binds a first target region of a HBV gene or genome, and
   wherein the administering results in a reduction of
   number of HBV viral episomes,
   replication of the HBV gene or genome, and/or
   expression of a protein product encoded by the HBV gene or genome,
   wherein the reduction is at least 60%, at least 70%, at least 80%, at least 90%, at least 95%, at least 99%, or greater than 99%, compared to administering a suitable control.

3. A method of modulating expression of an HBV gene or genome comprising contacting the HBV gene or genome with an epigenetic editing system,
   wherein the epigenetic editing system comprises
   a first DNA binding domain, a first DNMT domain, and a transcriptional repressor domain or one or more nucleic acid molecules encoding thereof,
   wherein the first DNA binding domain binds a first target region of the HBV gene or genome, and
   wherein the contacting results in a reduction of expression of a gene product encoded by the HBV gene or genome, optionally, wherein the gene product is a nucleic acid or a protein, wherein the reduction is at least 60%, at least 70%, at least 80%, at least 90%, at least 95%, at least 99%, or greater than 99%, compared to contacting the HBV genome with a suitable control.

4. A method of inhibiting viral replication in a cell infected with an HBV comprising administering an epigenetic editing system,
wherein the epigenetic editing system comprises
a first DNA binding domain, a first DNMT domain, and a transcriptional repressor domain or
one or more nucleic acid molecules encoding thereof,
wherein the first DNA binding domain binds a first target region of a HBV gene or genome, and wherein the epigenetic editing system targets a target region of the HBV gene or genome, and
wherein the administering results in a reduction of number of HBV viral episomes or replication of the HBV gene or genome,
wherein the reduction is at least 60%, at least 70%, at least 80%, at least 90%, at least 95%, at least 99%, or greater than 99%, compared to administering a suitable control.

5. The method of any one of embodiments 1-4, wherein the reduction is at least 70%.

6. The method of any one of embodiments 1-4, wherein the reduction is at least 80%.

7. The method of any one of embodiments 1-4, wherein the reduction is at least 90%.

8. The method of any one of embodiments 1-4, wherein the reduction is at least 95%.

9. The method of any one of embodiments 1-4, wherein the reduction is at least 99%, 10. The method of any one of embodiments 1-4, wherein the reduction is greater than 99%.

11. The method of any one of embodiments 1-10, wherein the HBV genome is a covalently closed circular DNA (cccDNA).

12. The method of any one of embodiments 1-10, wherein the HBV genome is an HBV integrated DNA.

13. The method of any one of embodiments 1-12, wherein the HBV genome comprises HBV genotype A.

14. The method of any one of embodiments 1-12, wherein the HBV genome comprises HBV genotype B.

15. The method of any one of embodiments 1-12, wherein the HBV genome comprises HBV genotype C.

16. The method of any one of embodiments 1-12, wherein the HBV genome comprises, HBV genotype D.

17. The method of any one of embodiments 1-12, wherein the HBV genome comprises HBV genotype E.

18. The method of any one of embodiments 1-12, wherein the HBV genome comprises HBV genotype F.

19. The method of any one of embodiments 1-12, wherein the HBV genome comprises HBV genotype G.

20. The method of any one of embodiments 1-12, wherein the HBV genome comprises HBV genotype H.

21. The method of any one of embodiments 1-12, wherein the HBV genome comprises a sequence with at least 80%, at least 90%, at least 95%, at least 99%, or greater than 99% sequence identity to an HBV genome sequence provided herein.

22. The method of any one of embodiments 1-21, wherein the first target region is located in a region of the HBV genome within nucleotides 0-303 of an HBV genome provided herein.

23. The method of any one of embodiments 1-21, wherein the first target region is located within nucleotides 0-303 of SEQ ID NO: 1082.

24. The method of any one of embodiments 1-21, wherein the first target region is located within nucleotides 0-303 of SEQ ID NO: 1083.

25. The method of any one of embodiments 1-21, wherein the first target region is located in a region of the HBV genome within nucleotides 1000-2448 of an HBV genome provided herein.

26. The method of any one of embodiments 1-21, wherein the first target region is located within nucleotides 1000-2448 of SEQ ID NO: 1082.

27. The method of any one of embodiments 1-21, wherein the first target region is located within nucleotides 1000-2448 of SEQ ID NO: 1083.

28. The method of any one of embodiments 1-21, wherein the first target region is located in a region of the HBV genome within nucleotides 2802-3182 of an HBV genome provided herein.

29. The method of any one of embodiments 1-21, wherein the first target region is located within nucleotides 2802-3182 of SEQ ID NO: 1082.

30. The method of any one of embodiments 1-21, wherein the first target region is located within nucleotides 2802-3182 of SEQ ID NO: 1083.

31. The method of any one of embodiments 1-21, wherein the first target region of the HBV genome is located in an HBV CpG island (CGI).

32. The method of embodiment 31, wherein the CGI is an HBV canonical CGI.

33. The method of embodiment 31, wherein the CGI is canonical CGI-I.

34. The method of embodiment 31, wherein the CGI is canonical CGI-I of HBV genotype D.

35. The method of embodiment 33, wherein CGI-I spans nucleotides 186-288 of SEQ ID NO: 1082.

36. The method of embodiment 33, wherein CGI-I spans nucleotides 186-288 of SEQ ID NO: 1083.

37. The method of embodiment 31, wherein the CGI is canonical CGI-II.

38. The method of embodiment 31, wherein the CGI is canonical CGI-II HBV genotype D.

39. The method of embodiment 38, wherein the CGI is CGI II spans nucleotides 1,217-1,670 of SEQ ID NO: 1082.

40. The method of embodiment 38, wherein the CGI is CGI II spans nucleotides 1,217-1,670 of SEQ ID NO: 1083.

41. The method of embodiment 31, wherein the CGI is canonical CGI-III.

42. The method of embodiment 31, wherein the CGI is canonical CGI-III HBV genotype D.

43. The method of embodiment 42, wherein the CGI is CGI-III spans nucleotides 2,282-2,448 of SEQ ID NO: 1082.

44. The method of embodiment 42, wherein the CGI is CGI-III spans nucleotides 2,282-2,448 of SEQ ID NO: 1083.

45. The method of any one of embodiments 1-21, wherein the first target region of the HBV genome is located in a promotor.

46. The method of embodiment 45, wherein the first target region of the HBV genome is located in the sp1 promoter.

47. The method of embodiment 45, wherein the first target region of the HBV genome is located in sp2 promoter.

48. The method of embodiment 45, wherein the first target region of the HBV genome is located in cp promoter.

49. The method of embodiment 45, wherein the first target region of the HBV genome is located in xp promoter.

50. The method of any one of embodiments 1-21, wherein the first target region of the HBV genome is located in an enhancer region.

51. The method of embodiment 50, wherein the first target region of the HBV genome is located in Enh I.

52. The method of embodiment 50, wherein the first target region of the HBV genome is located in Enh II.

53. The method of any one of embodiments 1-21, wherein the first target region of the HBV genome is located in a section of the HBV genome that encodes a transcript.

54. The method of embodiment 53, wherein the first target region of the HBV genome is located in a section of the HBV genome that encodes a pgRNA transcript.

55. The method of embodiment 53, wherein the first target region of the HBV genome is located in a section of the HBV genome that encodes a preCore RNA transcript.

56. The method of embodiment 53, wherein the first target region of the HBV genome is located in a section of the HBV genome that encodes a preS RNA transcript.

57. The method of embodiment 53, wherein the first target region of the HBV genome is located in a section of the HBV genome that encodes an S RNA transcript.

58. The method of embodiment 53, wherein the first target region of the HBV genome is located in a section of the HBV genome that encodes an HBx RNA transcript.

59. The method of any one of embodiments 1-21, wherein the first target region of the HBV genome is within 1000, 900, 800, 700, 600, 500, 400, 300, 200, or 100 base pairs (bp) of an HBV transcription start site (TSS).

60. The method of embodiment 59, wherein the TSS is a pg RNA TSS.

61. The method of embodiment 60, wherein the first target region is within 600, within 500, within 400, within 300, within 200, or within 100 base pairs of the pg RNA TSS.

62. The method of embodiment 60, wherein the pg RNA TSS is located at nucleotide 1820 of SEQ ID NO: 1082 or at nucleotide 1820 of SEQ ID NO: 1083.

63. The method of embodiment 60, wherein the first target region is within 600 base pairs of nucleotide 1820 in SEQ ID NO: 1082.

64. The method of embodiment 60, wherein the first target region is within 600 base pairs of nucleotide 1820 in SEQ ID NO: 1083.

65. The method of embodiment 60, wherein the first target region is within 500 base pairs of nucleotide 1820 in SEQ ID NO: 1082.

66. The method of embodiment 60, wherein the first target region is within 500 base pairs of nucleotide 1820 in SEQ ID NO: 1083.

67. The method of embodiment 60, wherein the first target region is within 400 base pairs of nucleotide 1820 in SEQ ID NO: 1082.

68. The method of embodiment 60, wherein the first target region is within 400 base pairs of nucleotide 1820 in SEQ ID NO: 1083.

69. The method of embodiment 60, wherein the first target region is within 300 base pairs of nucleotide 1820 in SEQ ID NO: 1082.

70. The method of embodiment 60, wherein the first target region is within 300 base pairs of nucleotide 1820 in SEQ ID NO: 1083.

71. The method of embodiment 60, wherein the first target region is within 200 base pairs of nucleotide 1820 in SEQ ID NO: 1082.

72. The method of embodiment 60, wherein the first target region is within 200 base pairs of nucleotide 1820 in SEQ ID NO: 1083.

73. The method of embodiment 60, wherein the first target region is within 100 base pairs of nucleotide 1820 in SEQ ID NO: 1082 or wherein the first target region is within 100 base pairs of nucleotide 1820 in SEQ ID NO: 1083.

74. The method of embodiment 59, wherein the TSS is a preC RNA TSS.

75. The method of embodiment 74, wherein the first target region is within 600, within 500, within 400, within 300, within 200, or within 100 base pairs of the preC RNA TSS.

76. The method of embodiment 74, wherein the preC RNA TSS is located at nucleotide 1791 of SEQ ID NO: 1082 or at nucleotide 1791 of SEQ ID NO: 1083.

77. The method of embodiment 74, wherein the first target region is within 600 base pairs of nucleotide 1791 in SEQ ID NO: 1082.

78. The method of embodiment 74, wherein the first target region is within 600 base pairs of nucleotide 1791 in SEQ ID NO: 1083.

79. The method of embodiment 74, wherein the first target region is within 500 base pairs of nucleotide 1791 in SEQ ID NO: 1082.

80. The method of embodiment 74, wherein the first target region is within 500 base pairs of nucleotide 1791 in SEQ ID NO: 1083.

81. The method of embodiment 74, wherein the first target region is within 400 base pairs of nucleotide 1791 in SEQ ID NO: 1082.

82. The method of embodiment 74, wherein the first target region is within 400 base pairs of nucleotide 1791 in SEQ ID NO: 1083.

83. The method of embodiment 74, wherein the first target region is within 300 base pairs of nucleotide 1791 in SEQ ID NO: 1082.

84. The method of embodiment 74, wherein the first target region is within 300 base pairs of nucleotide 1791 in SEQ ID NO: 1083.

85. The method of embodiment 74, wherein the first target region is within 200 base pairs of nucleotide 1791 in SEQ ID NO: 1082.

86. The method of embodiment 74, wherein the first target region is within 200 base pairs of nucleotide 1791 in SEQ ID NO: 1083.

87. The method of embodiment 74, wherein the first target region is within 100 base pairs of nucleotide 1791 in SEQ ID NO: 1082.

88. The method of embodiment 74, wherein the first target region is within 100 base pairs of nucleotide 1791 in SEQ ID NO: 1083.

89. The method of embodiment 59, wherein the TSS is a preS2 RNA TSS.

90. The method of embodiment 89, wherein the first target region is within 600, within 500, within 400, within 300, within 200, or within 100 base pairs of the preS2 RNA TSS.

91. The method of embodiment 89, wherein the preS2 RNA TSS is located at nucleotide 3159 of SEQ ID NO: 1082 or at nucleotide 3159 of SEQ ID NO: 1083.

92. The method of embodiment 89, wherein the first target region is within 600 base pairs of nucleotide 3159 in SEQ ID NO: 1082.

93. The method of embodiment 89, wherein the first target region is within 600 base pairs of nucleotide 3159 in SEQ ID NO: 1083.

94. The method of embodiment 89, wherein the first target region is within 500 base pairs of nucleotide 3159 in SEQ ID NO: 1082.

95. The method of embodiment 89, wherein the first target region is within 500 base pairs of nucleotide 3159 in SEQ ID NO: 1083.

96. The method of embodiment 89, wherein the first target region is within 400 base pairs of nucleotide 3159 in SEQ ID NO: 1082.

97. The method of embodiment 89, wherein the first target region is within 400 base pairs of nucleotide 3159 in SEQ ID NO: 1083.

98. The method of embodiment 89, wherein the first target region is within 300 base pairs of nucleotide 3159 in SEQ ID NO: 1082.

99. The method of embodiment 89, wherein the first target region is within 300 base pairs of nucleotide 3159 in SEQ ID NO: 1083.

100. The method of embodiment 89, wherein the first target region is within 200 base pairs of nucleotide 3159 in SEQ ID NO: 1082.

101. The method of embodiment 89, wherein the first target region is within 200 base pairs of nucleotide 3159 in SEQ ID NO: 1083.

102. The method of embodiment 89, wherein the first target region is within 100 base pairs of nucleotide 3159 in SEQ ID NO: 1082.

103. The method of embodiment 89, wherein the first target region is within 100 base pairs of nucleotide 3159 in SEQ ID NO: 1083.

104. The method of embodiment 89, wherein the TSS is an HBx RNA TSSs.

105. The method of embodiment 104, wherein the first target region is within 600, within 500, within 400, within 300, within 200, or within 100 base pairs of the HBx RNA TSS.

106. The method of embodiment 105, wherein the HBx RNA TSS is located at a nucleotide within the sequence of nucleotides 1243-1338 of SEQ ID NO: 1082 or nucleotides 1243-1338 of SEQ ID NO: 1083.

107. The method of embodiment 105, wherein the first target region is within 600 base pairs of nucleotide 1243 in SEQ ID NO: 1082.

108. The method of embodiment 105, wherein the first target region is within 600 base pairs of nucleotide 1243 in SEQ ID NO: 1083.

109. The method of embodiment 105, wherein the first target region is within 500 base pairs of nucleotide 1243 in SEQ ID NO: 1082.

110. The method of embodiment 105, wherein the first target region is within 500 base pairs of nucleotide 1243 in SEQ ID NO: 1083.

111. The method of embodiment 105, wherein the first target region is within 400 base pairs of nucleotide 1243 in SEQ ID NO: 1082.

112. The method of embodiment 105, wherein the first target region is within 400 base pairs of nucleotide 1243 in SEQ ID NO: 1083.

113. The method of embodiment 105, wherein the first target region is within 300 base pairs of nucleotide 1243 in SEQ ID NO: 1082.

114. The method of embodiment 105, wherein the first target region is within 300 base pairs of nucleotide 1243 in SEQ ID NO: 1083.

115. The method of embodiment 105, wherein the first target region is within 200 base pairs of nucleotide 1243 in SEQ ID NO: 1082.

116. The method of embodiment 105, wherein the first target region is within 200 base pairs of nucleotide 1243 in SEQ ID NO: 1083.

117. The method of embodiment 105, wherein the first target region is within 100 base pairs of nucleotide 1243 in SEQ ID NO: 1082.

118. The method of embodiment 105, wherein the first target region is within 100 base pairs of nucleotide 1243 in SEQ ID NO: 1083.

119. The method of embodiment 105, wherein the first target region is within 600 base pairs of nucleotide 1338 in SEQ ID NO: 1083.

120. The method of embodiment 105, wherein the first target region is within 500 base pairs of nucleotide 1338 in SEQ ID NO: 1082.

121. The method of embodiment 105, wherein the first target region is within 500 base pairs of nucleotide 1338 in SEQ ID NO: 1083.

122. The method of embodiment 105, wherein the first target region is within 400 base pairs of nucleotide 1338 in SEQ ID NO: 1082.

123. The method of embodiment 105, wherein the first target region is within 400 base pairs of nucleotide 1338 in SEQ ID NO: 1083.

124. The method of embodiment 105, wherein the first target region is within 300 base pairs of nucleotide 1338 in SEQ ID NO: 1082.

125. The method of embodiment 105, wherein the first target region is within 300 base pairs of nucleotide 1338 in SEQ ID NO: 1083.

126. The method of embodiment 105, wherein the first target region is within 200 base pairs of nucleotide 1338 in SEQ ID NO: 1082.

127. The method of embodiment 105, wherein the first target region is within 200 base pairs of nucleotide 1338 in SEQ ID NO: 1083.

128. The method of embodiment 105, wherein the first target region is within 100 base pairs of nucleotide 1338 in SEQ ID NO: 1082.

129. The method of embodiment 105, wherein the first target region is within 100 base pairs of nucleotide 1338 in SEQ ID NO: 1083.

130. The method of any one of embodiments 1-129, wherein the reduction is a reduction in the number of HBV viral episomes.

131. The method of embodiment 130, wherein the reduction is a reduction in the number of cccDNA genomes.

132. The method of embodiment 130, wherein the reduction is a reduction in total HBV DNA.

133. The method of any one of embodiments 1-129, wherein the reduction is a reduction in the replication of the HBV genome.

134. The method of any one of embodiments 1-129, wherein the reduction is a reduction in a level of expression of a protein product encoded by the HBV genome.

135. The method of embodiment 130, wherein the reduction is a reduction in a level of HBsAg.

136. The method of embodiment 130, wherein the reduction is a reduction in a level of HBeAg.

137. The method of any one of embodiments 1-129, wherein the reduction is a reduction of total HBV DNA of at least 70%, at least 80%, at least 90%, at least 95%, at least 99%, or at least 99.9%, and wherein the reduction is maintained for at least 14 days after the contacting or the administering.

138. The method of any one of embodiments 1-129, wherein the reduction is a reduction of HBeAg of at least 70%, at least 80%, at least 90%, at least 95%, at least 99%, or at least 99.9%, and wherein the reduction is maintained for at least 14 days after the contacting or the administering.

139. The method of any one of embodiments 1-129, wherein the reduction is a reduction of HBsAg of at least 70%, at least 80%, at least 90%, at least 95%, at least 99%, or at least 99.9%, and wherein the reduction is maintained at or below that level for at least 14 days after the contacting or the administering.

140. The method of any one of embodiments 137-139, wherein the reduction is a reduction of at least 90%.

141. The method of any one of embodiments 137-139, wherein the reduction is a reduction of at least 95%.

142. The method of any one of embodiments 137-139, wherein the reduction is a reduction of at least 99%.

143. The method of any one of embodiments 137-139, wherein the reduction is a reduction of at least 99.9%.

144. The method of any one of embodiments 140-143, wherein the reduction is maintained for at least 14 days after the contacting or the administering.

145. The method of embodiment 144, wherein the reduction is maintained for at least 21 days.

146. The method of embodiment 144, wherein the reduction is maintained for at least 28 days.

147. The method of embodiment 144, wherein the reduction is maintained for at least 35 days.

148. The method of embodiment 144, wherein the reduction is maintained for at least 42 days.

149. The method of embodiment 144, wherein the reduction is maintained for at least 56 days.

150. The method of embodiment 144, wherein the reduction is maintained for at least 70 days.

151. The method of embodiment 144, wherein the reduction is maintained for at least 84 days.

152. The method of embodiment 144, wherein the reduction is maintained for at least 112 days.

153. The method of embodiment 144, wherein the reduction is maintained for at least 140 days.

154. The method of embodiment 144, wherein the reduction is maintained for at least 168 days.

155. The method of embodiment 144, wherein the reduction is maintained for at least 6 months.

156. The method of embodiment 144, wherein the reduction is maintained for at least 7 months.

157. The method of embodiment 144, wherein the reduction is maintained for at least 8 months.

158. The method of embodiment 144, wherein the reduction is maintained for at least 9 months.

159. The method of embodiment 144, wherein the reduction is maintained for at least 12 months.

160. The method of embodiment 144, wherein the reduction is maintained for at least 18 months.

161. The method of embodiment 144, wherein the reduction is maintained for at least 24 months.

162. The method of any one of embodiments 1-161, wherein the method does not comprise contacting the HBV gene or genome with a nucleoside or nucleotide analog (NUC) or wherein the method does not comprise administering a NUC to the subject.

163. The method of any one of embodiments 1-162, wherein the method further comprises contacting the HBV gene or genome with a nucleoside or nucleotide analog (NUC) or wherein the method further comprises administering a NUC to the subject.

164. The method of any one of embodiments 1-163, wherein the first DNA binding domain comprises a CRISPR-Cas protein.

165. The method of embodiment 164, wherein the epigenetic editing system further comprises a first guide RNA (gRNA) that comprises a region complementary to a strand of the first target region.

166. The method of embodiment 165, wherein the gRNA comprises a sequence selected from a gRNA provided herein, preferably wherein the gRNA comprises a sequence provided in Table 12 or 13.

167. The method of any one of embodiments 1-164, wherein the first DNA binding domain comprises a zinc-finger protein.

168. The method of embodiment 167, wherein the zinc-finger protein comprises a zinc-finger motif with a sequence selected from any zinc finger or zinc finger motif provided herein, e.g., in Table 1 or Table 18.

169. The method of embodiment 167 or 168, wherein the zinc-finger protein comprises a sequence of any of the zinc finger epigenetic repressors provided herein.

170. The method of any one of embodiments 1-169, wherein the transcriptional repressor domain comprises ZIM3.

171. The method of any one of embodiments 1-170, wherein the first DNMT domain is a DNMT3A domain or a DNMT3L domain.

172. The method of embodiment 171, wherein the first DNMT domain comprises a sequence of a DNMT domain provided herein.

173. The method of any one of embodiments 1-172, wherein the epigenetic editing system further comprises a second DNMT domain or a nucleic acid encoding thereof.

174. The method of embodiment 173, wherein the second DNMT domain is a DNMT3A domain or a DNMT3L domain.

175. The method of embodiment 173 or 174, wherein the second DNMT domain comprises a sequence of a DNMT domain provided herein.

176. The method of any one of embodiments 173-175, wherein the epigenetic editing system comprises a fusion protein or a nucleic acid encoding thereof, and wherein the fusion protein comprises the first DNA binding domain, the first DNMT domain, the repressor domain and the second DNMT domain.

177. The method of embodiment 176, wherein the fusion protein further comprises a nuclear localization sequence (NLS).

178. The method of embodiment 177, wherein the fusion protein comprises a sequence of a fusion protein provided herein.

179. The method of any one of embodiments 1-178, wherein the epigenetic editing system further comprises a second DNA binding domain or a nucleic acid encoding a second DNA binding domain, wherein the second DNA binding domain binds a second target region of the HBV genome.

180. The method of embodiment 179, wherein the second target region is a target region recited in any of embodiments 22-129.

181. The method of embodiment 179 or 180, wherein the second DNA binding domain comprises a CRISPR-Cas protein.

182. The method of any one of embodiments 1-180, wherein the epigenetic editing system comprises at least one CRISPR-Cas DNA binding domain and at least two different gRNAs.

183. The method of embodiment 182, wherein the epigenetic editing system comprises a first gRNA binding the first HBV target region and a second gRNA binding a second HBV target region, wherein the first and second target regions are not identical.

184. The method of embodiment 183, wherein the first gRNA comprises a gRNA sequence provided herein, e.g., a sequence provided in Table 12 or 13, and wherein the second gRNA comprises a different gRNA sequence provided herein, e.g., a sequence provided in Table 12 or 13.

185. The method of embodiment 179, wherein the second DNA binding domain comprises a zinc-finger protein.

186. The method of embodiment 185, wherein the zinc-finger protein of the second DNA binding domain comprises a zinc-finger motif with a sequence selected from a zinc finger motif sequence provided herein, e.g., a zinc finger motif provided in Table 1.

187. The method of embodiment 185 or 186, wherein the zinc-finger protein of the second DNA binding domain comprises a sequence of a zinc finger motif provided in Table 1.

188. The method of any one of embodiments 179-187, wherein the epigenetic editing system comprises a first fusion protein or a first nucleic acid encoding thereof and a second fusion protein or a second nucleic acid encoding thereof,
wherein the first fusion protein comprises the first DNA binding domain and the first DNMT domain, and
wherein the second fusion protein comprises the second DNA binding domain and the transcriptional repressor domain.

189. The method of embodiment 188, wherein the first fusion protein comprises a sequence of a fusion protein provided herein.

190. The method of embodiment 188 or 189, wherein the second fusion protein comprises a sequence of a fusion protein provided herein.

191. The method of any one of embodiments 179-190, wherein the epigenetic editing system further comprises a third DNA binding domain or a nucleic acid encoding a third DNA binding domain, wherein the third DNA binding domain binds to a third target region of the HBV genome, optionally, wherein the third DNA binding domain comprises a comprises at least one CRISPR-Cas DNA binding domain, optionally wherein the epigenetic editing system comprises a third gRNA comprising a sequence complementary to a strand of a third HBV target region, optionally wherein the third gRNA comprises a gRNA sequence provided herein, optionally, a gRNA sequence provided in Table 12 or 13, optionally, wherein the third DNA binding domain is comprised in a fusion protein comprising a DNMT domain and a transcriptional repressor domain, optionally, wherein the fusion protein is a fusion protein provided herein.

192. A method, comprising administering an epigenetic editing system to a subject,
wherein the subject is characterized by the presence of detectable levels of HBV DNA, HBsAg, and/or HBeAg in the plasma of the subject,
wherein the epigenetic editing system comprises a first DNA binding domain, a first DNMT domain, and a transcriptional repressor domain or one or more nucleic acid molecules encoding the same, wherein the first DNA binding domain binds a first target region of an HBV gene or genome,
wherein the administering results in a reduction of the level of HBV DNA, the level of HBsAg, and/or the level of HBsAg in the plasma of the subject,
wherein the reduction of the level of HBV DNA, of the level of HBsAg, and/or of the level of HBsAg in the plasma of the subject, is at least 90% (a 1-log reduction) compared to the respective level observed or observable in the plasma of the subject prior to the administering, and
wherein the 1-log reduction is maintained for at least 14 days after the administering.

193. The method of embodiment 192, wherein the reduction of the level of HBV DNA in the plasma of the subject is at least 90% (a 1-log reduction).

194. The method of embodiment 192, wherein the reduction of the level of HBV DNA in the plasma of the subject is at least 99% (a 2-log reduction).

195. The method of embodiment 192, wherein the reduction of the level of HBsAg in the plasma of the subject is at least 90% (a 1-log reduction).

196. The method of embodiment 192, wherein the reduction of the level of HBsAg in the plasma of the subject is at least 99% (a 2-log reduction).

197. The method of embodiment 192, wherein the reduction of the level of HBeAg in the plasma of the subject is at least 90% (a 1-log reduction).

198. The method of embodiment 192, wherein the reduction of the level of HBeAg in the plasma of the subject is at least 99% (a 2-log reduction).

199. The method of any one of embodiments 192-198, wherein the reduction is maintained for at least 21 days.

200. The method of any one of embodiments 192-198, wherein the reduction is maintained for at least 28 days.

201. The method of any one of embodiments 192-198, wherein the reduction is maintained for at least 35 days.

202. The method of any one of embodiments 192-198, wherein the reduction is maintained for at least 42 days.

203. The method of any one of embodiments 192-198, wherein the reduction is maintained for at least 56 days.

204. The method of any one of embodiments 192-198, wherein the reduction is maintained for at least 70 days.

205. The method of any one of embodiments 192-198, wherein the reduction is maintained for at least 84 days.

206. The method of any one of embodiments 192-198, wherein the reduction is maintained for at least 112 days.

207. The method of any one of embodiments 192-198, wherein the reduction is maintained for at least 140 days.

208. The method of any one of embodiments 192-198, wherein the reduction is maintained for at least 168 days.

209. The method of any one of embodiments 192-198, wherein the reduction is maintained for at least 6 months.

210. The method of any one of embodiments 192-198, wherein the reduction is maintained for at least 9 months.

211. The method of any one of embodiments 192-198, wherein the reduction is maintained for at least 12 months.

212. The method of any one of embodiments 192-198, wherein the reduction is maintained for at least 24 months.

213. The method of any one of embodiments 192-212, wherein the HBV genome comprises HBV genotype A.

214. The method of any one of embodiments 192-212, wherein the HBV genome comprises HBV genotype B.

215. The method of any one of embodiments 192-212, wherein the HBV genome comprises HBV genotype C.

216. The method of any one of embodiments 192-212, wherein the HBV genome comprises, HBV genotype D.

217. The method of any one of embodiments 192-212, wherein the HBV genome comprises HBV genotype E.

218. The method of any one of embodiments 192-212, wherein the HBV genome comprises HBV genotype F.

219. The method of any one of embodiments 192-212, wherein the HBV genome comprises HBV genotype G.

220. The method of any one of embodiments 192-212, wherein the HBV genome comprises HBV genotype H.

221. The method of any one of embodiments 192-212, wherein the HBV genome comprises a sequence with at least 80%, at least 90%, at least 95%, at least 99%, or greater than 99% sequence identity to an HBV genome sequence provided herein.

222. The method of any one of embodiments 192-221, wherein the first target region is located in a region of the HBV genome within nucleotides 0-303 of an HBV genome provided herein.

223. The method of any one of embodiments 192-221, wherein the first target region is located within nucleotides 0-303 of SEQ ID NO: 1082.

224. The method of any one of embodiments 192-221, wherein the first target region is located within nucleotides 0-303 of SEQ ID NO: 1083.

225. The method of any one of embodiments 192-221, wherein the first target region is located in a region of the HBV genome within nucleotides 1000-2448 of an HBV genome provided herein.

226. The method of any one of embodiments 192-221, wherein the first target region is located within nucleotides 1000-2448 of SEQ ID NO: 1082.

227. The method of any one of embodiments 192-221, wherein the first target region is located within nucleotides 1000-2448 of SEQ ID NO: 1083.

228. The method of any one of embodiments 192-221, wherein the first target region is located in a region of the HBV genome within nucleotides 2802-3182 of an HBV genome provided herein.

229. The method of any one of embodiments 192-221, wherein the first target region is located within nucleotides 2802-3182 of SEQ ID NO: 1082.

230. The method of any one of embodiments 192-221, wherein the first target region is located within nucleotides 2802-3182 of SEQ ID NO: 1083.

231. The method of any one of embodiments 192-221, wherein the first target region of the HBV genome is located in an HBV CpG island (CGI).

232. The method of embodiment 231, wherein the CGI is an HBV canonical CGI.

233. The method of embodiment 231, wherein the CGI is canonical CGI-I.

234. The method of embodiment 231, wherein the CGI is canonical CGI-I of HBV genotype D.

235. The method of embodiment 233, wherein CGI-I spans nucleotides 186-288 of SEQ ID NO: 1082.

236. The method of embodiment 233, wherein CGI-I spans nucleotides 186-288 of SEQ ID NO: 1083.

237. The method of embodiment 231, wherein the CGI is canonical CGI-II.

238. The method of embodiment 231, wherein the CGI is canonical CGI-II HBV genotype D.

239. The method of embodiment 238, wherein the CGI is CGI II spans nucleotides 1,217-1,670 of SEQ ID NO: 1082.

240. The method of embodiment 238, wherein the CGI is CGI II spans nucleotides 1,217-1,670 of SEQ ID NO: 1083.

241. The method of embodiment 231, wherein the CGI is canonical CGI-III.

242. The method of embodiment 231, wherein the CGI is canonical CGI-III HBV genotype D.

243. The method of embodiment 242, wherein the CGI is CGI-III spans nucleotides 2,282-2,448 of SEQ ID NO: 1082.

244. The method of embodiment 242, wherein the CGI is CGI-III spans nucleotides 2,282-2,448 of SEQ ID NO: 1083.

245. The method of any one of embodiments 192-221, wherein the first target region of the HBV genome is located in a promotor.

246. The method of embodiment 245, wherein the first target region of the HBV genome is located in the sp1 promoter.

247. The method of embodiment 245, wherein the first target region of the HBV genome is located in sp2 promoter.

248. The method of embodiment 245, wherein the first target region of the HBV genome is located in cp promoter.

249. The method of embodiment 245, wherein the first target region of the HBV genome is located in xp promoter.

250. The method of any one of embodiments 192-221, wherein the first target region of the HBV genome is located in an enhancer region.

251. The method of embodiment 250, wherein the first target region of the HBV genome is located in Enh I.

252. The method of embodiment 250, wherein the first target region of the HBV genome is located in Enh II.

253. The method of any one of embodiments 192-221, wherein the first target region of the HBV genome is located in a section of the HBV genome that encodes a transcript.

254. The method of embodiment 253, wherein the first target region of the HBV genome is located in a section of the HBV genome that encodes a pgRNA transcript.

255. The method of embodiment 253, wherein the first target region of the HBV genome is located in a section of the HBV genome that encodes a preCore RNA transcript.

256. The method of embodiment 253, wherein the first target region of the HBV genome is located in a section of the HBV genome that encodes a preS RNA transcript.

257. The method of embodiment 253, wherein the first target region of the HBV genome is located in a section of the HBV genome that encodes an S RNA transcript.

258. The method of embodiment 253, wherein the first target region of the HBV genome is located in a section of the HBV genome that encodes an HBx RNA transcript.

259. The method of any one of embodiments 192-221, wherein the first target region of the HBV genome is within 1000, 900, 800, 700, 600, 500, 400, 300, 200, or 100 base pairs (bp) of an HBV transcription start site (TSS).

260. The method of embodiment 259, wherein the TSS is a pg RNA TSS.

261. The method of embodiment 260, wherein the first target region is within 600, within 500, within 400, within 300, within 200, or within 100 base pairs of the pg RNA TSS.

262. The method of embodiment 260, wherein the pg RNA TSS is located at nucleotide 1820 of SEQ ID NO: 1082 or at nucleotide 1820 of SEQ ID NO: 1083.

263. The method of embodiment 260, wherein the first target region is within 600 base pairs of nucleotide 1820 in SEQ ID NO: 1082.

264. The method of embodiment 260, wherein the first target region is within 600 base pairs of nucleotide 1820 in SEQ ID NO: 1083.

265. The method of embodiment 260, wherein the first target region is within 500 base pairs of nucleotide 1820 in SEQ ID NO: 1082.

266. The method of embodiment 260, wherein the first target region is within 500 base pairs of nucleotide 1820 in SEQ ID NO: 1083.

267. The method of embodiment 260, wherein the first target region is within 400 base pairs of nucleotide 1820 in SEQ ID NO: 1082.

268. The method of embodiment 260, wherein the first target region is within 400 base pairs of nucleotide 1820 in SEQ ID NO: 1083.

269. The method of embodiment 260, wherein the first target region is within 300 base pairs of nucleotide 1820 in SEQ ID NO: 1082.

270. The method of embodiment 260, wherein the first target region is within 300 base pairs of nucleotide 1820 in SEQ ID NO: 1083.

271. The method of embodiment 260, wherein the first target region is within 200 base pairs of nucleotide 1820 in SEQ ID NO: 1082.

272. The method of embodiment 260, wherein the first target region is within 200 base pairs of nucleotide 1820 in SEQ ID NO: 1083.

273. The method of embodiment 260, wherein the first target region is within 100 base pairs of nucleotide 1820 in SEQ ID NO: 1082 or wherein the first target region is within 100 base pairs of nucleotide 1820 in SEQ ID NO: 1083.

274. The method of embodiment 259, wherein the TSS is a preC RNA TSS.

275. The method of embodiment 274, wherein the first target region is within 600, within 500, within 400, within 300, within 200, or within 100 base pairs of the preC RNA TSS.

276. The method of embodiment 274, wherein the preC RNA TSS is located at nucleotide 1791 of SEQ ID NO: 1082 or at nucleotide 1791 of SEQ ID NO: 1083.

277. The method of embodiment 274, wherein the first target region is within 600 base pairs of nucleotide 1791 in SEQ ID NO: 1082.

278. The method of embodiment 274, wherein the first target region is within 600 base pairs of nucleotide 1791 in SEQ ID NO: 1083.

279. The method of embodiment 274, wherein the first target region is within 500 base pairs of nucleotide 1791 in SEQ ID NO: 1082.

280. The method of embodiment 274, wherein the first target region is within 500 base pairs of nucleotide 1791 in SEQ ID NO: 1083.

281. The method of embodiment 274, wherein the first target region is within 400 base pairs of nucleotide 1791 in SEQ ID NO: 1082.

282. The method of embodiment 274, wherein the first target region is within 400 base pairs of nucleotide 1791 in SEQ ID NO: 1083.

283. The method of embodiment 274, wherein the first target region is within 300 base pairs of nucleotide 1791 in SEQ ID NO: 1082.

284. The method of embodiment 274, wherein the first target region is within 300 base pairs of nucleotide 1791 in SEQ ID NO: 1083.

285. The method of embodiment 274, wherein the first target region is within 200 base pairs of nucleotide 1791 in SEQ ID NO: 1082.

286. The method of embodiment 274, wherein the first target region is within 200 base pairs of nucleotide 1791 in SEQ ID NO: 1083.

287. The method of embodiment 274, wherein the first target region is within 100 base pairs of nucleotide 1791 in SEQ ID NO: 1082.

288. The method of embodiment 274, wherein the first target region is within 100 base pairs of nucleotide 1791 in SEQ ID NO: 1083.

289. The method of embodiment 259, wherein the TSS is a preS2 RNA TSS.

290. The method of embodiment 289, wherein the first target region is within 600, within 500, within 400, within 300, within 200, or within 100 base pairs of the preS2 RNA TSS.

291. The method of embodiment 289, wherein the preS2 RNA TSS is located at nucleotide 3159 of SEQ ID NO: 1082 or at nucleotide 3159 of SEQ ID NO: 1083.

292. The method of embodiment 289, wherein the first target region is within 600 base pairs of nucleotide 3159 in SEQ ID NO: 1082.

293. The method of embodiment 289, wherein the first target region is within 600 base pairs of nucleotide 3159 in SEQ ID NO: 1083.

294. The method of embodiment 289, wherein the first target region is within 500 base pairs of nucleotide 3159 in SEQ ID NO: 1082.

295. The method of embodiment 289, wherein the first target region is within 500 base pairs of nucleotide 3159 in SEQ ID NO: 1083.

296. The method of embodiment 289, wherein the first target region is within 400 base pairs of nucleotide 3159 in SEQ ID NO: 1082.

297. The method of embodiment 289, wherein the first target region is within 400 base pairs of nucleotide 3159 in SEQ ID NO: 1083.

298. The method of embodiment 289, wherein the first target region is within 300 base pairs of nucleotide 3159 in SEQ ID NO: 1082.

299. The method of embodiment 289, wherein the first target region is within 300 base pairs of nucleotide 3159 in SEQ ID NO: 1083.

300. The method of embodiment 289, wherein the first target region is within 200 base pairs of nucleotide 3159 in SEQ ID NO: 1082.

301. The method of embodiment 289, wherein the first target region is within 200 base pairs of nucleotide 3159 in SEQ ID NO: 1083.

302. The method of embodiment 289, wherein the first target region is within 100 base pairs of nucleotide 3159 in SEQ ID NO: 1082.

303. The method of embodiment 289, wherein the first target region is within 100 base pairs of nucleotide 3159 in SEQ ID NO: 1083.

304. The method of embodiment 259, wherein the TSS is an HBx RNA TSSs.

305. The method of embodiment 304, wherein the first target region is within 600, within 500, within 400, within 300, within 200, or within 100 base pairs of the HBx RNA TSS.

306. The method of embodiment 304, wherein the HBx RNA TSS is located at a nucleotide within the sequence of nucleotides 1243-1338 of SEQ ID NO: 1082 or nucleotides 1243-1338 of SEQ ID NO: 1083.

307. The method of embodiment 304, wherein the first target region is within 600 base pairs of nucleotide 1243 in SEQ ID NO: 1082.

308. The method of embodiment 304, wherein the first target region is within 600 base pairs of nucleotide 1243 in SEQ ID NO: 1083.

309. The method of embodiment 304, wherein the first target region is within 500 base pairs of nucleotide 1243 in SEQ ID NO: 1082.

310. The method of embodiment 304, wherein the first target region is within 500 base pairs of nucleotide 1243 in SEQ ID NO: 1083.

311. The method of embodiment 304, wherein the first target region is within 400 base pairs of nucleotide 1243 in SEQ ID NO: 1082.

312. The method of embodiment 304, wherein the first target region is within 400 base pairs of nucleotide 1243 in SEQ ID NO: 1083.

313. The method of embodiment 304, wherein the first target region is within 300 base pairs of nucleotide 1243 in SEQ ID NO: 1082.

314. The method of embodiment 304, wherein the first target region is within 300 base pairs of nucleotide 1243 in SEQ ID NO: 1083.

315. The method of embodiment 304, wherein the first target region is within 200 base pairs of nucleotide 1243 in SEQ ID NO: 1082.

316. The method of embodiment 304, wherein the first target region is within 200 base pairs of nucleotide 1243 in SEQ ID NO: 1083.

317. The method of embodiment 304, wherein the first target region is within 100 base pairs of nucleotide 1243 in SEQ ID NO: 1082.

318. The method of embodiment 304, wherein the first target region is within 100 base pairs of nucleotide 1243 in SEQ ID NO: 1083.

319. The method of embodiment 304, wherein the first target region is within 600 base pairs of nucleotide 1338 in SEQ ID NO: 1083.

320. The method of embodiment 304, wherein the first target region is within 500 base pairs of nucleotide 1338 in SEQ ID NO: 1082.

321. The method of embodiment 304, wherein the first target region is within 500 base pairs of nucleotide 1338 in SEQ ID NO: 1083.

322. The method of embodiment 304, wherein the first target region is within 400 base pairs of nucleotide 1338 in SEQ ID NO: 1082.

323. The method of embodiment 304, wherein the first target region is within 400 base pairs of nucleotide 1338 in SEQ ID NO: 1083.

324. The method of embodiment 304, wherein the first target region is within 300 base pairs of nucleotide 1338 in SEQ ID NO: 1082.

325. The method of embodiment 304, wherein the first target region is within 300 base pairs of nucleotide 1338 in SEQ ID NO: 1083.

326. The method of embodiment 304, wherein the first target region is within 200 base pairs of nucleotide 1338 in SEQ ID NO: 1082.

327. The method of embodiment 304, wherein the first target region is within 200 base pairs of nucleotide 1338 in SEQ ID NO: 1083.

328. The method of embodiment 304, wherein the first target region is within 100 base pairs of nucleotide 1338 in SEQ ID NO: 1082.

329. The method of embodiment 304, wherein the first target region is within 100 base pairs of nucleotide 1338 in SEQ ID NO: 1083.

330. The method of any one of embodiments 192-329, wherein the reduction is a reduction in the number of HBV viral episomes.

331. The method of embodiment 330, wherein the reduction is a reduction in the number of cccDNA genomes.

332. The method of embodiment 330, wherein the reduction is a reduction in total HBV DNA.

333. The method of any one of embodiments 192-329, wherein the reduction is a reduction in the replication of the HBV genome.

334. The method of any one of embodiments 192-329, wherein the reduction is a reduction in a level of expression of a protein product encoded by the HBV genome.

335. The method of embodiment 330, wherein the reduction is a reduction in a level of HBsAg.

336. The method of embodiment 330, wherein the reduction is a reduction in a level of HBeAg.

337. The method of any one of embodiments 192-329, wherein the reduction is a reduction of total HBV DNA of at least 70%, at least 80%, at least 90%, at least 95%, at least 99%, or at least 99.9%, and wherein the reduction is maintained for at least 14 days after the contacting or the administering.

338. The method of any one of embodiments 192-329, wherein the reduction is a reduction of HBeAg of at least 70%, at least 80%, at least 90%, at least 95%, at least 99%, or at least 99.9%, and wherein the reduction is maintained for at least 14 days after the contacting or the administering.

339. The method of any one of embodiments 192-329, wherein the reduction is a reduction of HBsAg of at least 70%, at least 80%, at least 90%, at least 95%, at least 99%, or at least 99.9%, and wherein the reduction is maintained at or below that level for at least 14 days after the contacting or the administering.

340. The method of any one of embodiments 337-339, wherein the reduction is a reduction of at least 90%.

341. The method of any one of embodiments 337-339, wherein the reduction is a reduction of at least 95%.

342. The method of any one of embodiments 337-339, wherein the reduction is a reduction of at least 99%.

343. The method of any one of embodiments 337-339, wherein the reduction is a reduction of at least 99.9%.

344. The method of any one of embodiments 340-343, wherein the reduction is maintained for at least 14 days after the contacting or the administering.

345. The method of embodiment 344, wherein the reduction is maintained for at least 21 days.

346. The method of embodiment 344, wherein the reduction is maintained for at least 28 days.

347. The method of embodiment 344, wherein the reduction is maintained for at least 35 days.

348. The method of embodiment 344, wherein the reduction is maintained for at least 42 days.

349. The method of embodiment 344, wherein the reduction is maintained for at least 56 days.

350. The method of embodiment 344, wherein the reduction is maintained for at least 70 days.

351. The method of embodiment 344, wherein the reduction is maintained for at least 84 days.

352. The method of embodiment 344, wherein the reduction is maintained for at least 112 days.

353. The method of embodiment 344, wherein the reduction is maintained for at least 140 days.

354. The method of embodiment 344, wherein the reduction is maintained for at least 168 days.

355. The method of embodiment 344, wherein the reduction is maintained for at least 6 months.

356. The method of embodiment 344, wherein the reduction is maintained for at least 7 months.

357. The method of embodiment 344, wherein the reduction is maintained for at least 8 months.

358. The method of embodiment 344, wherein the reduction is maintained for at least 9 months.

359. The method of embodiment 344, wherein the reduction is maintained for at least 12 months.

360. The method of embodiment 344, wherein the reduction is maintained for at least 18 months.

361. The method of embodiment 344, wherein the reduction is maintained for at least 24 months.

362. The method of any one of embodiments 192-361, wherein the method does not comprise contacting the HBV gene or genome with a nucleoside or nucleotide analog (NUC) or wherein the method does not comprise administering a NUC to the subject.

363. The method of any one of embodiments 192-362, wherein the method further comprises contacting the HBV gene or genome with a nucleoside or nucleotide analog (NUC) or wherein the method further comprises administering a NUC to the subject.

364. The method of any one of embodiments 192-363, wherein the first DNA binding domain comprises a CRISPR-Cas protein.

365. The method of embodiment 364, wherein the epigenetic editing system further comprises a first guide RNA (gRNA) that comprises a region complementary to a strand of the first target region.

366. The method of embodiment 365, wherein the gRNA comprises a sequence selected from a gRNA provided herein, preferably wherein the gRNA comprises a sequence provided in Table 12 or 13.

367. The method of any one of embodiments 192-364, wherein the first DNA binding domain comprises a zinc-finger protein.

368. The method of embodiment 367, wherein the zinc-finger protein comprises a zinc-finger motif with a sequence selected from any zinc finger or zinc finger motif provided herein, e.g., in Table 1 or Table 18.

369. The method of embodiment 367 or 368, wherein the zinc-finger protein comprises a sequence of any of the zinc finger epigenetic repressors provided herein.

370. The method of any one of embodiments 192-369, wherein the transcriptional repressor domain comprises ZIM3.

371. The method of any one of embodiments 192-370, wherein the first DNMT domain is a DNMT3A domain or a DNMT3L domain.

372. The method of embodiment 371, wherein the first DNMT domain comprises a sequence of a DNMT domain provided herein.

373. The method of any one of embodiments 1-372, wherein the epigenetic editing system comprises the fusion protein provided in SEQ ID NO: 1248 or the fusion protein provided in SEQ ID NO: 1252 and at least one guide RNA, wherein the guide RNA is the guide RNA provided as gRNA #003, gRNA #007, gRNA #008, gRNA #009, gRNA #011, or gRNA #015 herein.

374. An epigenetic editing system for use in the method of any one of embodiments 1-373, comprising:
a fusion protein or a nucleic acid encoding the fusion protein,
wherein the fusion protein comprises:
(a) a DNA-binding domain that binds a target region of a HBV gene or genome,
(b) a first DNA methyltransferase (DNMT) domain, and
(c) a transcriptional repressor domain.

375. The epigenetic editing system of embodiment 374, wherein the fusion protein comprises a sequence of a fusion protein provided herein.

376. The epigenetic editing system of embodiment 374 or 375, wherein the DNA-binding domain is a CRISPR-Cas DNA binding domain, and wherein the epigenetic editing system comprises at least gRNA provided herein.

377. The epigenetic editing system of embodiment 374, wherein the epigenetic editing system comprises the fusion protein provided in SEQ ID NO: 1248 or the fusion protein provided in SEQ ID NO: 1252 and at least one guide RNA, wherein the guide RNA is the guide RNA provided as gRNA #003, gRNA #007, gRNA #008, gRNA #009, gRNA #011, or gRNA #015 herein.

378. An epigenetic editing system comprising:
1. a first fusion protein or a nucleic acid encoding the first fusion protein, wherein the first fusion protein comprises a first DNA binding domain and a first DNMT domain, wherein the first DNA binding domain binds a first target region of a HBV genome, and
2. a second fusion protein or a nucleic acid encoding the second fusion protein, wherein the second fusion protein comprises a second DNA binding domain and a transcriptional repressor domain, wherein the second DNA binding domain binds a second target region of the HBV genome.

379. The epigenetic system of embodiment 378, wherein the epigenetic editing system is capable of reducing a number of the HBV viral episome, replication of the HBV, or expression of a gene product encoded by the HBV genome, wherein said reduction is at least about 20% compared to contacting the HBV genome with a suitable control.

380. The epigenetic system of embodiment 378 or 379, wherein the HBV genome is a covalently closed circular DNA (cccDNA) or an HBV integrated DNA.

381. The epigenetic system of embodiments 378-380, wherein the HBV genome comprises HBV genotype A, HBV genotype B, HBV genotype C, HBV genotype D, HBV genotype E, HBV genotype F, HBV genotype G or HBV genotype H.

382. The epigenetic system of embodiments 378-381, wherein the HBV genome comprises a sequence with at least 80% identity to an HBV genome provided herein.

383. The epigenetic system of embodiments 378-381, further comprising a third fusion protein or a nucleic acid encoding the third fusion protein, wherein the third fusion protein comprises a third DNA binding domain and a second DNMT domain, wherein the third DNA binding domain binds a third target region of the HBV genome.

384. The epigenetic system of embodiment 383, wherein the first target region, the second target region or the third target region is located in a region of the HBV genome within nucleotide 0-303, 1000-2448 or 2802-3182 of an HBV genome provided herein.

385. The epigenetic system of embodiment 383, wherein the first target region, the second target region or the third target region of the HBV genome is located in a CpG island.

386. The epigenetic system of embodiment 383, wherein the first target region, the second target region or the third target region of the HBV genome is located in a promotor.

387. The epigenetic system of embodiment 383, wherein the first target region, the second target region or the third target region of the HBV genome is located in a section of the HBV genome that encodes a transcript selected from the group consisting of a pgRNA, a precure mRNA, a preS mRNA, a S mRNA, and a X mRNA.

388. The epigenetic system of embodiment 383, wherein the first DNA binding domain, the second DNA binding domain or the third DNA binding domain comprises a CRISPR-Cas protein.

389. The epigenetic system of embodiment 388, wherein the epigenetic editing system further comprises a first gRNA that comprises a region complementary to a strand of the first target region, a second gRNA that comprises a region complementary to a strand of the second target region or a third RNA that comprises a region complementary to a strand of the third target region.

390. The epigenetic system of embodiment 389, wherein the first gRNA comprises a sequence selected from a gRNA sequence provided herein, e.g., provided in Table 12 or 13, the second gRNA comprises a sequence selected from a gRNA sequence provided herein, e.g., provided in Table 12 or 13, and/or the third gRNA comprises a sequence selected from a gRNA sequence provided herein, e.g., provided in Table 12 or 13.

391. The epigenetic system of embodiment 383, wherein the first DNA binding domain, the second DNA binding domain or the third DNA binding domain comprises a zinc-finger protein.

392. The epigenetic system of embodiment 391, wherein the zinc-finger protein comprises a zinc-finger motif with a sequence selected from a zinc finger motif provided herein.

393. The epigenetic system of embodiment 391 or 392, wherein the zinc-finger protein comprises a sequence of a zinc finger motif provided in Table 1.

394. The epigenetic system of embodiments 378-393, wherein the transcriptional repressor domain comprises ZIM3.

395. The epigenetic system of embodiments 378-394, wherein the first DNMT domain is a DNMT3A domain or a DNMT3L domain.

396. The epigenetic system of embodiment 395, wherein the first DNMT domain comprises a sequence of a DNMT provided herein.

397. The epigenetic system of embodiment 383, wherein the second DNMT domain is a DNMT3A domain or a DNMT3L domain.

398. The epigenetic system of embodiment 397, wherein the second DNMT domain comprises a sequence of a DNMT domain provided herein.

399. The epigenetic system of embodiment 378-398, wherein the first fusion protein comprises a sequence of a fusion protein provided herein.

400. The epigenetic system of embodiments 378-399, wherein the second fusion protein comprises a sequence of a fusion protein provided herein.

401. The epigenetic system of embodiments 383-399, wherein the third fusion protein comprises a sequence of a fusion protein provided herein.

402. The method of any one of embodiments 1-401, wherein the epigenetic editing system comprises a nucleic acid sequence provided in Table 18.

LISTING #2 of Exemplary Embodiments:

1. A method of modifying an epigenetic state of a hepatitis B virus (HBV) gene or genome, comprising contacting the HBV gene or genome with an epigenetic editing system,
wherein the epigenetic editing system comprises
a first DNA binding domain, a first DNMT domain, and a transcriptional repressor domain or
one or more nucleic acid molecules encoding thereof, and
wherein the contacting results in a reduction of:
number of HBV viral episomes,
replication of the HBV gene or genome, or
expression of a protein product encoded by the HBV gene or genome,
wherein the reduction is at least about 20% compared to contacting the HBV gene or genome with a suitable control or without contacting the HBV gene or genome with the epigenetic editing system.

2. A method of treating an HBV infection in a subject comprising administering an epigenetic editing system to the subject,
wherein the epigenetic editing system comprises
a first DNA binding domain, a first DNMT domain, and a transcriptional repressor domain or
one or more nucleic acid molecules encoding thereof, and
wherein the administering results in a reduction of:
number of HBV viral episomes,
replication of the HBV gene or genome, or
expression of a protein product encoded by an HBV gene or genome,
wherein the reduction is at least about 20% compared to administering a suitable control or without administering the epigenetic editing system.

3. A method of modulating expression of an HBV gene or genome comprising contacting the HBV gene or genome with an epigenetic editing system,
wherein the epigenetic editing system comprises
a first DNA binding domain, a first DNMT domain, and a transcriptional repressor domain or
one or more nucleic acid molecules encoding thereof, and
wherein the contacting results in a reduction of expression of a gene product encoded by the HBV gene or genome, optionally, wherein the gene product is a nucleic acid or a protein,
wherein the reduction is at least about 20% compared to contacting the HBV gene or genome with a suitable control or without contacting the HBV gene or genome with the epigenetic editing system.

4. A method of inhibiting viral replication in a cell infected with an HBV comprising contacting the cell with an epigenetic editing system,
wherein the epigenetic editing system comprises
a first DNA binding domain, a first DNMT domain, and a transcriptional repressor domain or one or more nucleic acid molecules encoding thereof,
wherein the epigenetic editing system targets a target region of an HBV gene or genome, and
wherein the contacting results in a reduction of number of HBV viral episomes or replication of the HBV gene or genome,
wherein the reduction is at least about 20% compared to contacting the cell with a suitable control or without contacting the cell with the epigenetic editing system.

5. A method of inhibiting viral replication in a subject infected with an HBV comprising administering an epigenetic editing system to the subject,
wherein the epigenetic editing system comprises
a first DNA binding domain, a first DNMT domain, and a transcriptional repressor domain or one or more nucleic acid molecules encoding thereof,
wherein the epigenetic editing system targets a target region of the HBV gene or genome, and
wherein the administering results in a reduction of number of HBV viral episomes,
replication of the HBV gene or genome, or
expression of a protein product encoded by an HBV gene or genome,
wherein the reduction is at least about 20% compared to administering a suitable control or without administering the epigenetic editing system.

6. The method of embodiment 2 or 5, wherein the reduction is at least about 30%, about 40%, about 50%, about 60% or about 70% compared to administering the suitable control.

7. The method of any one of embodiments 1, and 3-4, wherein the reduction is at least about 30%, about 40%, about 50%, about 60% or about 70% compared to contacting with the suitable control.

8. The method of any one of embodiments 1-7, wherein the reduction is maintained for at least 6 days, 19 days, 27 days, 42 days, or 168 days.

9. The method of embodiment 4, wherein the contacting further results in a reduction of a protein product.

10. The method of embodiment 5, wherein the administering further results in a reduction of a protein product.

11. The method of any one of embodiments 1-2 and 9-10, wherein the protein product comprises a HBe antigen.

12. The method of any one of embodiments 1-2 and 9-10, wherein the protein produce comprises a HBs antigen.

13. The method of any one of embodiments 1-12, wherein the HBV genome is a covalently closed circular DNA (cccDNA) or an HBV integrated DNA.

14. The method of any one of embodiments 1-13, wherein the HBV genome comprises HBV genotype A, HBV genotype B, HBV genotype C, HBV genotype D, HBV genotype E, HBV genotype F, HBV genotype G or HBV genotype H.

15. The method of any one of embodiments 1-14, wherein the HBV genome comprises a sequence with at least 80% identity to an HBV genome sequence provided herein.

16. The method of embodiment 15, wherein the first target region is located in a region of the HBV genome within nucleotide 0-303, 1000-2448 or 2802-3182 of an HBV genome provided herein.

17. The method of any one of embodiments 1-15, wherein the first target region of the HBV genome is located in a CpG island.

18. The method of any one of embodiments 1-15, wherein the first target region of the HBV genome is located in a promotor.

19. The method of any one of embodiments 1-15, wherein the first target region of the HBV genome is located in a section of the HBV genome that encodes a transcript selected from the group consisting of a pgRNA, a precure mRNA, a preS mRNA, a S mRNA, and a X mRNA.

20. The method of any one of embodiments 1-19, wherein the first DNA binding domain comprises a CRISPR-Cas protein.

21. The method of any one of embodiments 1-20, wherein the epigenetic editing system further comprises a first guide RNA (gRNA) that comprises a region complementary to a strand of the first target region.

22. The method of embodiment 21, wherein the gRNA comprises a sequence selected from a gRNA provided herein, e.g., in Table 12 and/or 13.

23. The method of any one of embodiments 1-19, wherein the first DNA binding domain comprises a zinc-finger protein.

24. The method of embodiment 23, wherein the zinc-finger protein comprises a zinc-finger motif with a sequence selected from any zinc finger or zinc finger motif provided herein, e.g., in Table 1 or Table 18.

25. The method of embodiment 23 or 24, wherein the zinc-finger protein comprises a sequence of any of the zinc finger epigenetic repressors provided herein.

26. The method of any one of embodiments 1-25, wherein the transcriptional repressor domain comprises ZIM3.

27. The method of any one of embodiments 1-26, wherein the first DNMT domain is a DNMT3A domain or a DNMT3L domain.

28. The method of embodiment 27, wherein the first DNMT domain comprises a sequence of a DNMT domain provided herein.

29. The method of any one of embodiments 1-28, wherein the epigenetic editing system further comprises a second DNMT domain or a nucleic acid encoding thereof.

30. The method of embodiments 29, wherein the second DNMT domain is a DNMT3A domain or a DNMT3L domain.

31. The method of embodiment 30, wherein the second DNMT domain comprises a sequence of a DNMT domain provided herein.

32. The method of any one of embodiments 29-31, wherein the epigenetic editing system comprises a fusion protein or a nucleic acid encoding thereof, and wherein the fusion protein comprises the first DNA binding domain, the first DNMT domain, the repressor domain and the second DNMT domain.

33. The method of embodiment 32, wherein the fusion protein further comprises a nuclear localization sequence (NLS).

34. The method of embodiment 33, wherein the fusion protein comprises a sequence of a fusion protein provided herein.

35. The method of any one of embodiments 1-34, wherein the epigenetic editing system further comprises a second DNA binding domain or a nucleic acid encoding thereof, wherein the second DNA binding domain binds a second target region of the HBV genome.

36. The method of embodiment 35, wherein the second target region is located in a region of the HBV genome within nucleotide 0-303, 1000-2448 or 2802-3182.

37. The method of embodiment 35, wherein the second target region of the HBV genome is located in a CpG island.

38. The method of embodiment 35, wherein the second target region of the HBV genome is located in a promotor.

39. The method of embodiment 35, wherein the second target region of the HBV genome is located in a section of the HBV genome that encodes a transcript selected from the group consisting of a pgRNA, a precure mRNA, a preS mRNA, a S mRNA, and a X mRNA.

40. The method of any one of embodiments 35-39, wherein the second DNA binding domain comprises a CRISPR-Cas protein.

41. The method of embodiment 40, wherein the epigenetic editing system further comprises a second gRNA that comprises a region complementary to a strand of the second target region.

42. The method of embodiment 41, wherein the gRNA comprises a sequence selected from a gRNA sequence provided herein, e.g., a sequence provided in Table 12 and/or 13.

43. The method of any one of embodiments 35-39, wherein the second DNA binding domain comprises a zinc-finger protein.

44. The method of embodiment 43, wherein the zinc-finger protein comprises a zinc-finger motif with a sequence selected from a zinc finger motif sequence provided herein, e.g., a zinc finger motif provided in Table 1 and/or 18.

45. The method of embodiment 43 or 44, wherein the zinc-finger protein comprises a sequence of a zinc finger motif provided in Table 1 and/or 18.

46. The method of any one of embodiments 35-45, wherein the epigenetic editing system comprises a first fusion protein or a first nucleic acid encoding thereof and a second fusion protein or a second nucleic acid encoding thereof,
    wherein the first fusion protein comprises the first DNA binding domain and the first DNMT domain, and
    wherein the second fusion protein comprises the second DNA binding domain and the transcriptional repressor domain.

47. The method of embodiment 46, wherein the first fusion protein comprises a sequence of a fusion protein provided herein.

48. The method of embodiment 46, wherein the second fusion protein comprises a sequence of a fusion protein provided herein.

49. The method of any one of embodiments 46-48, wherein the epigenetic editing system further comprises a third DNA binding domain or a nucleic acid encoding thereof, wherein the third DNA binding domain binds to a third target region of the HBV genome.

50. The method of embodiment 49, wherein the third target region is located in a region of the HBV genome within nucleotide 0-303, 1000-2448 or 2802-3182.

51. The method of embodiment 49, wherein the third target region of the HBV genome is located in a CpG island.

52. The method of embodiment 49, wherein the third target region of the HBV genome is located in a promotor.

53. The method of embodiment 49, wherein the third target region of the HBV genome is located in a section of the HBV genome that encodes a transcript selected from the group consisting of a pgRNA, a precure mRNA, a preS mRNA, a S mRNA, and a X mRNA.

54. The method of any one of embodiments 49-53, wherein the third DNA binding domain comprises a CRISPR-Cas protein.

55. The method of embodiment 54, wherein the epigenetic editing system further comprises a third gRNA that comprises a region complementary to a strand of the third target region.

56. The method of embodiment 55, wherein the third gRNA comprises a sequence selected from a gRNA sequence provided herein, e.g., of a gRNA sequence provided in Table 12 and/or 13.

57. The method of any one of embodiments 49-53, wherein the third DNA binding domain comprises a zinc-finger protein.

58. The method of embodiment 57, wherein the zinc-finger protein comprises a zinc-finger motif with a sequence selected from a zinc finger motif provided herein.

59. The method of embodiment 57 or 58, wherein the zinc-finger protein comprises a sequence of a zinc finger motif provided in Table 1 and/or 18.

60. The method of any one of embodiments 49-59, wherein the epigenetic editing system further comprises a second DNMT domain or a nucleic acid encoding thereof.

61. The method of embodiment 60, wherein the second DNMT domain is a DNMT3A domain or a DNMT3L domain.

62. The method of embodiment 61, wherein the epigenetic editing system comprises a third fusion protein or a nucleic acid encoding thereof, wherein the third fusion protein comprises the third DNA binding domain and the second DNMT domain.

63. The method of embodiment 62, wherein the third fusion protein comprises a sequence of a fusion protein provided herein.

64. An epigenetic editing system comprising:
    a fusion protein or a nucleic acid encoding the fusion protein,
    wherein the fusion protein comprises:
        (a) a DNA-binding domain that binds a target region of a HBV gene or genome,
        (b) a first DNA methyltransferase (DNMT) domain, and
        (c) a transcriptional repressor domain.

65. The epigenetic system of embodiment 64, wherein the epigenetic editing system is capable of reducing a number of the HBV viral episome, replication of the HBV, or expression of a gene product encoded by the HBV gene or genome, wherein said reduction is at least about 20% compared to contacting the HBV gene or genome with a suitable control.

66. The epigenetic system of embodiment 64 or 65, wherein the HBV genome is a covalently closed circular DNA (cccDNA) or an HBV integrated DNA.

67. The epigenetic system of any one of embodiments 64-66, wherein the HBV genome comprises HBV genotype A, HBV genotype B, HBV genotype C, HBV genotype D, HBV genotype E, HBV genotype F, HBV genotype G or HBV genotype H.

68. The epigenetic system of any one of embodiments 64-67, wherein the HBV genome comprises a sequence with at least 80% identity to an HBV genome sequence provided herein.

69. The epigenetic system of any one of embodiments 64-68, wherein the target region is located in a region of the HBV genome within nucleotide 0-303, 1000-2448 or 2802-3182 of an HBV genome sequence provided herein.

70. The epigenetic system of any one of embodiments 64-68, wherein the target region of the HBV genome is located in a CpG island.

71. The epigenetic system of any one of embodiments 63-68, wherein the target region of the HBV genome is located in a promotor.

72. The epigenetic system of any one of embodiments 63-68, wherein the target region of the HBV genome is located in a section of the HBV genome that encodes a transcript selected from the group consisting of a pgRNA, a precure mRNA, a preS mRNA, a S mRNA, and a X mRNA.

73. The epigenetic system of embodiments 63-72, wherein the DNA binding domain comprises a CRISPR-Cas protein.

74. The epigenetic system of embodiment 73, wherein the epigenetic editing system further comprises a gRNA that comprises a region complementary to a strand of the target region.

75. The epigenetic system of embodiment 74, wherein the gRNA comprises a sequence selected from a gRNA sequence provided herein, e.g., in Table 12 and/or 13.

76. The epigenetic system of any one of embodiments 63-72, wherein the DNA binding domain comprises a zinc-finger protein.

77. The epigenetic system of embodiment 76, wherein the zinc-finger protein comprises a zinc-finger motif with a sequence selected from a zinc finger motif provided herein.

78. The epigenetic system of embodiment 76 or 77, wherein the zinc-finger protein comprises a sequence of a zinc finger motif provided in Table 1 and/or 18.

79. The epigenetic system of any one of embodiments 63-78, wherein the transcriptional repressor domain comprises a sequence of a transcriptional repressor provided herein.

80. The epigenetic system of any one of embodiments 63-79, wherein the first DNMT domain is a DNMT3A domain or a DNMT3L domain.

81. The epigenetic system of embodiment 80, wherein the DNMT domain comprises a sequence of a DNMT domain provided herein.

82. The epigenetic system of any one of embodiments 63-81, wherein the fusion protein further comprises a second DNMT domain.

83. The epigenetic system of embodiment 82, wherein the second DNMT domain is a DNMT3A domain or a DNMT3L domain.

84. The epigenetic system of any one of embodiments 63-83, wherein the fusion protein further comprises a nuclear localization sequence (NLS).

85. The epigenetic system of embodiment 84, wherein the fusion protein comprises a sequence of a fusion protein provided herein.

86. An epigenetic editing system comprising:
a first fusion protein or a nucleic acid encoding the first fusion protein, wherein the first fusion protein comprises a first DNA binding domain and a first DNMT domain, wherein the first DNA binding domain binds a first target region of a HBV genome, and
a second fusion protein or a nucleic acid encoding the second fusion protein, wherein the second fusion protein comprises a second DNA binding domain and a transcriptional repressor domain, wherein the second DNA binding domain binds a second target region of the HBV genome.

87. The epigenetic system of embodiment 86, wherein the epigenetic editing system is capable of reducing a number of the HBV viral episome, replication of the HBV, or expression of a gene product encoded by the HBV genome, wherein said reduction is at least about 20% compared to contacting the HBV genome with a suitable control.

88. The epigenetic system of embodiment 86 or 87, wherein the HBV genome is a covalently closed circular DNA (cccDNA) or an HBV integrated DNA.

89. The epigenetic system of any one of embodiments 86-88, wherein the HBV genome comprises HBV genotype A, HBV genotype B, HBV genotype C, HBV genotype D, HBV genotype E, HBV genotype F, HBV genotype G or HBV genotype H.

90. The epigenetic system of any one of embodiments 86-89, wherein the HBV genome comprises a sequence with at least 80% identity to an HBV genome provided herein.

91. The epigenetic system of any one of embodiments 86-89, further comprising a third fusion protein or a nucleic acid encoding the third fusion protein, wherein the third fusion protein comprises a third DNA binding domain and a second DNMT domain, wherein the third DNA binding domain binds a third target region of the HBV genome.

92. The epigenetic system of embodiment 91, wherein the first target region, the second target region or the third target region is located in a region of the HBV genome within nucleotide 0-303, 1000-2448 or 2802-3182 of an HBV genome provided herein.

93. The epigenetic system of embodiment 91, wherein the first target region, the second target region or the third target region of the HBV genome is located in a CpG island.

94. The epigenetic system of embodiment 91, wherein the first target region, the second target region or the third target region of the HBV genome is located in a promotor.

95. The epigenetic system of embodiment 91, wherein the first target region, the second target region or the third target region of the HBV genome is located in a section of the HBV genome that encodes a transcript selected from the group consisting of a pgRNA, a precure mRNA, a preS mRNA, a S mRNA, and a X mRNA.

96. The epigenetic system of embodiment 91, wherein the first DNA binding domain, the second DNA binding domain or the third DNA binding domain comprises a CRISPR-Cas protein.

97. The epigenetic system of embodiment 96, wherein the epigenetic editing system further comprises a first gRNA that comprises a region complementary to a strand of the first target region, a second gRNA that comprises a region complementary to a strand of the second target region or a third RNA that comprises a region complementary to a strand of the third target region.

98. The epigenetic system of embodiment 97, wherein the first gRNA comprises a sequence selected from a gRNA sequence provided herein, e.g., provided in Table 12 and/or 13, the second gRNA comprises a sequence selected from a gRNA sequence provided herein, e.g., provided in Table 12 and/or 13, and/or the third gRNA comprises a sequence selected from a gRNA sequence provided herein, e.g., provided in Table 12 and/or 13.

99. The epigenetic system of embodiment 91, wherein the first DNA binding domain, the second DNA binding domain or the third DNA binding domain comprises a zinc-finger protein.

100. The epigenetic system of embodiment 99, wherein the zinc-finger protein comprises a zinc-finger motif with a sequence selected from a zinc finger motif provided herein.

101. The epigenetic system of embodiment 99 or 100, wherein the zinc-finger protein comprises a sequence of a zinc finger motif provided in Table 1 and/or 18.

102. The epigenetic system of any one of embodiments 86-101, wherein the transcriptional repressor domain comprises ZIM3.

103. The epigenetic system of any one of embodiments 86-102, wherein the first DNMT domain is a DNMT3A domain or a DNMT3L domain.

104. The epigenetic system of embodiment 103, wherein the first DNMT domain comprises a sequence of a DNMT provided herein.

105. The epigenetic system of embodiment 91, wherein the second DNMT domain is a DNMT3A domain or a DNMT3L domain.

106. The epigenetic system of embodiment 105, wherein the second DNMT domain comprises a sequence of a DNMT domain provided herein.

107. The epigenetic system of any one of embodiment 86-106, wherein the first fusion protein comprises a sequence of a fusion protein provided herein.

108. The epigenetic system of any one of embodiments 86-107, wherein the second fusion protein comprises a sequence of a fusion protein provided herein.

109. The epigenetic system of any one of embodiments 91-107, wherein the third fusion protein comprises a sequence of a fusion protein provided herein.

110. The method of any one of embodiments 1-63, wherein the epigenetic editing system comprises a nucleic acid sequence provided in Table 18.

111. A method of treating an HDV infection in a subject comprising administering an epigenetic editing system to the subject,
wherein the epigenetic editing system comprises
a first DNA binding domain, a first DNMT domain, and a transcriptional repressor domain or one or more nucleic acid molecules encoding thereof,
wherein the first DNA binding domain binds a first target region of a HBV gene or genome, and wherein the contacting results in a reduction of:
number of HDV viral episomes,
replication of the HDV gene or genome, or
expression of a protein product encoded by the HDV gene or genome,
wherein said reduction is at least about 20% compared to administering a suitable control.

112. A method of inhibiting viral replication in a cell infected with an HDV comprising administering an epigenetic editing system,
wherein the epigenetic editing system comprises
a first DNA binding domain, a first DNMT domain, and a transcriptional repressor domain or one or more nucleic acid molecules encoding thereof,
wherein the first DNA binding domain binds a first target region of a HBV gene or genome, and wherein the epigenetic editing system targets a target region of the HBV gene or genome, and
wherein the contacting results in a reduction of number of HDV viral episomes or replication of the HDV gene or genome,
wherein said reduction is at least about 20% compared to administering a suitable control.

113. The method of embodiment 111 or 112, wherein the first DNA binding domain comprises a CRISPR-Cas protein.

114. The method of embodiment 113, wherein the epigenetic editing system further comprises a first guide RNA (gRNA) that comprises a region complementary to a strand of the first target region.

115. The method of embodiment 114, wherein the gRNA comprises a sequence selected from a gRNA provided herein, e.g., in Table 12 and/or 13.

116. The method of embodiment 111 or 112, wherein the first DNA binding domain comprises a zinc-finger protein.

117. The method of embodiment 116, wherein the zinc-finger protein comprises a zinc-finger motif with a sequence selected from any zinc finger or zinc finger motif provided herein, e.g., in Table 1 and/or 18.

118. The method of embodiment 116 or 117, wherein the zinc-finger protein comprises a sequence of any of the zinc finger epigenetic repressors provided herein.

119. The method of any one of embodiments 111-118, wherein the transcriptional repressor domain comprises ZIM3.

120. The method of any one of embodiments 111-119, wherein the first DNMT domain is a DNMT3A domain or a DNMT3L domain.

121. The method of embodiment 120, wherein the first DNMT domain comprises a sequence of a DNMT domain provided herein.

122. The method of any one of embodiments 111-121, wherein the epigenetic editing system further comprises a second DNMT domain or a nucleic acid encoding thereof.

123. The method of embodiment 122, wherein the second DNMT domain is a DNMT3A domain or a DNMT3L domain.

124. The method of embodiment 123, wherein the second DNMT domain comprises a sequence of a DNMT domain provided herein.

125. The method of any one of embodiments 122-123, wherein the epigenetic editing system comprises a fusion protein or a nucleic acid encoding thereof, and wherein the fusion protein comprises the first DNA binding domain, the first DNMT domain, the repressor domain and the second DNMT domain.

126. The method of embodiment 125, wherein the fusion protein further comprises a nuclear localization sequence (NLS).

127. The method of embodiment 126, wherein the fusion protein comprises a sequence of a fusion protein provided herein.

128. The method of any one of embodiments 111-127, wherein the first DNA binding domain binds a target region of an HBV gene or genome encoding or controlling expression of an S-antigen.

In order that the present disclosure may be better understood, the following examples are set forth. These examples are for purposes of illustration only and are not to be construed as limiting the scope of the present disclosure in any manner.

EXAMPLES

Example 1: Selection of Target HBV Sequences for Epigenetic Silencing

Figure 2:
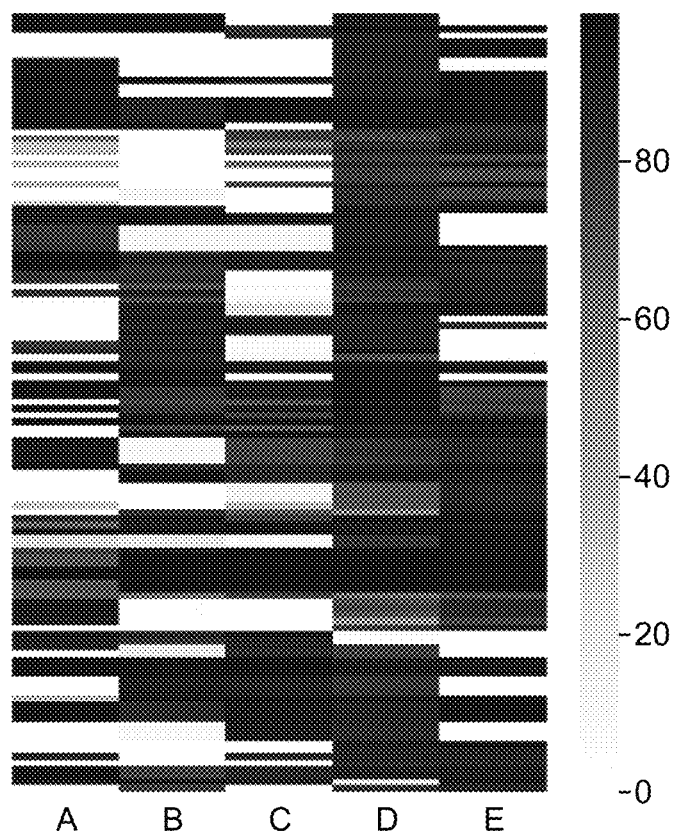
FIG. 2 is a heat map showing conservation of guide RNA target domains across different HBV genotypes.
Figure 3:
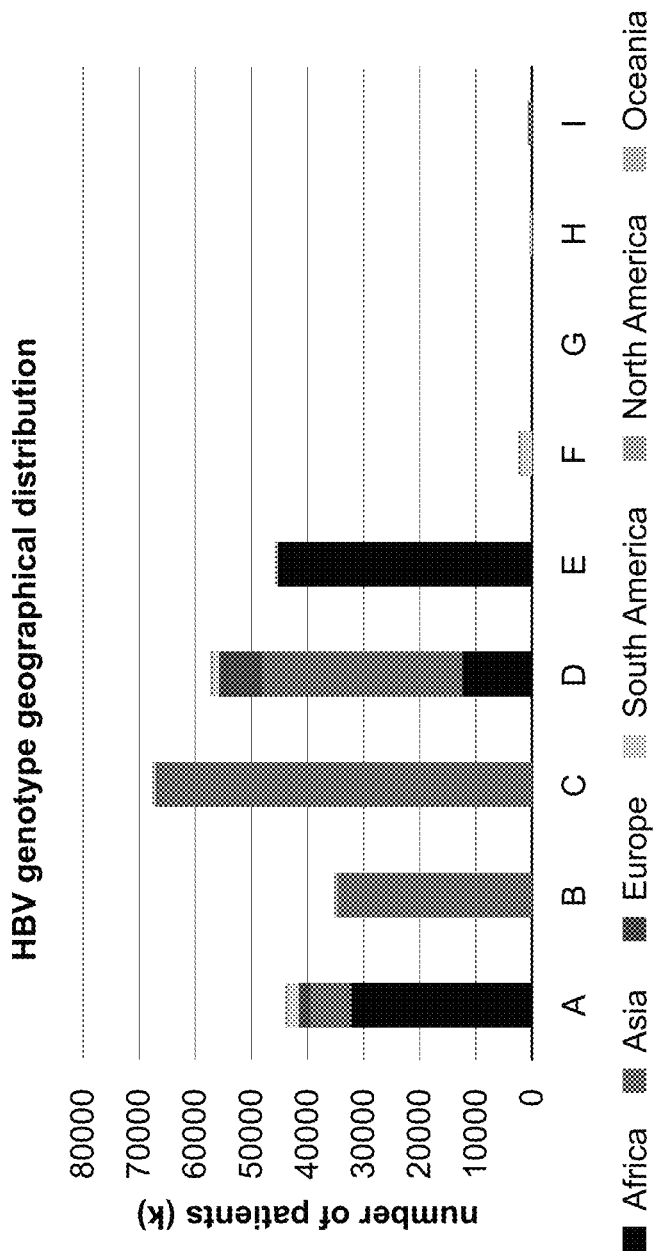
FIG. 3 is a bar graph illustrating the geographical distribution of different HBV genotypes.

Target sequences were manually and computationally designed using the representative HBV genome sequences (SEQ ID Nos. 1082, 1083) as a reference:
While target site design focused on CpG islands identified within the HBV genome, target sites outside of HBV CpG islands were also considered.
Table 2 presents some representative target sites that were identified as suitable for targeting with an epigenetic repressor.
Target domains identified above that are adjacent to a PAM sequence, e.g., an *S. pyogenes* Cas9 PAM sequence, can be targeted by a CRISPR-based epigenetic repressor, e.g., an epigenetic repressor comprising a dCas9 DNA-binding domain. For example, target sites 1-143 are suitable for dCas9-based epigenetic repressor targeting. FIG. 1 provides an overview over the position of the target sites identified in the HBV genome.
Target sites were analyzed for conservation across HBV genotypes A-E (FIGS. 2 and 3). Some target sites were identified that were well conserved across two or more, or in some cases all, HBV genotypes. Targeting such conserved sites allows for silencing different genotypes with the same epigenetic repressor.

Example 2: Guide RNA Assays in HepAD38 HBV Cells

Figure 4A:
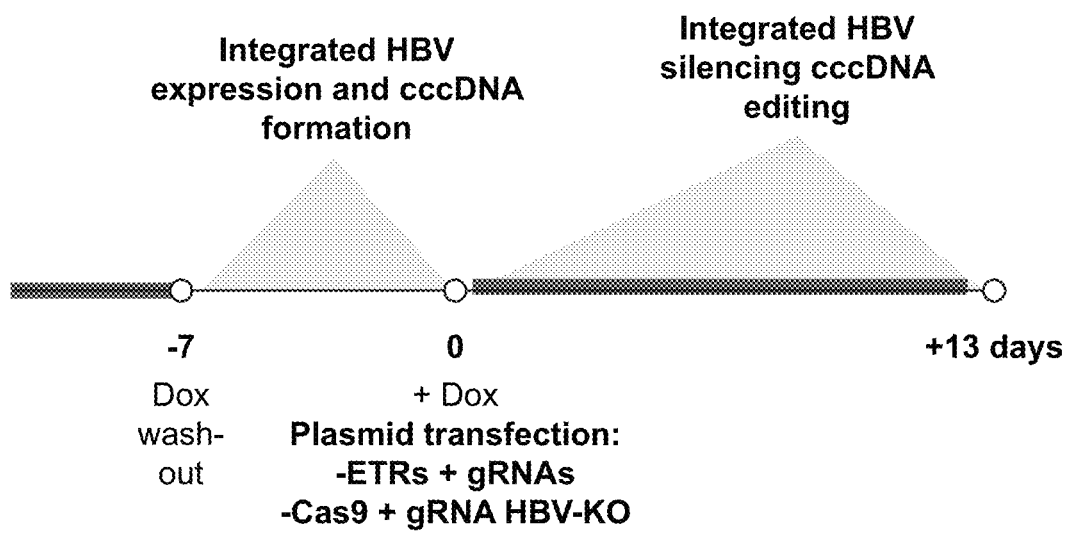
FIG. 4A is a diagram describing the experimental timeline for testing different CRISPR-based epigenetic repressors in HepAD38 cells, which express HPV in a doxycycline-inducible manner.
Figure 4B:
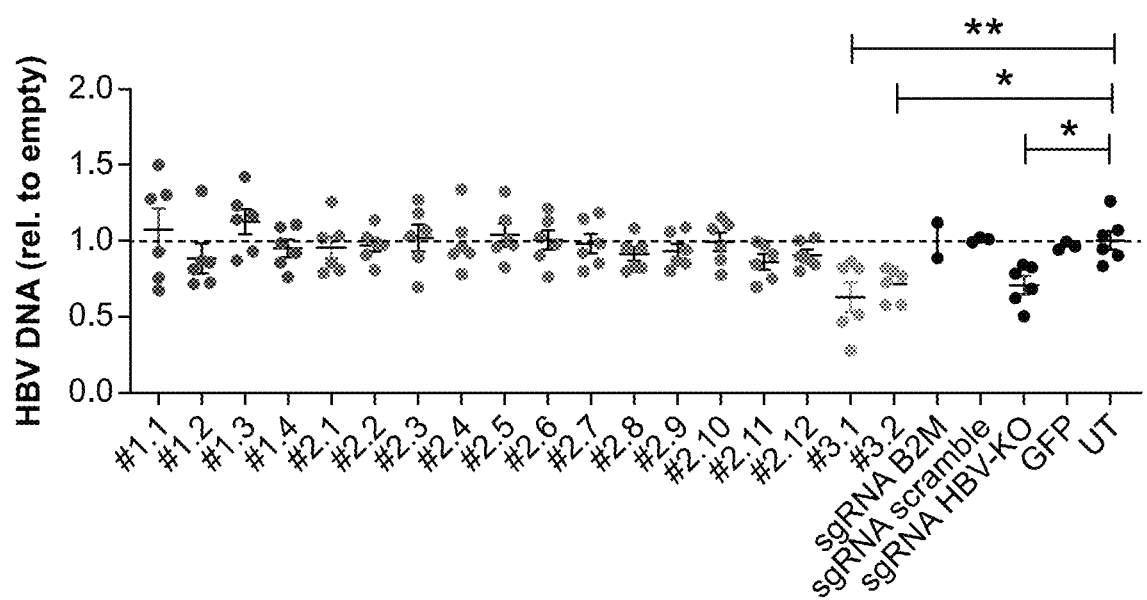
FIG. 4B is a diagram showing the repression of HBV by various CRISPR-based epigenetic repressors (#1.1-3.2). Controls: UT: untransfected control; GFP: transfection control without repressor; HBV-KO: CRISPR nuclease mediated knockout; sgRNA scramble: CRISPR-based repressor with sgRNA not targeting HBV; B2M: CRISPR-based repressor with sgRNA targeting B2M.

The HepAD38 cell line expresses the HBV genome under a doxycycline-inducible promoter (see, e.g., Ladner et al., Inducible expression of human hepatitis B virus (HBV) in stably transfected hepatoblastoma cells: a novel system for screening potential inhibitors of HBV replication. Antimicrob. Agents Chemother. 41:1715-1720(1997), incorporated herein by reference).
Results are shown in FIGS. 4A and B.

Example 3: Guide RNA Assays in HepG2-NTCP Cells

HepG2 cells were engineered by lentiviral transduction to express the human NTCP receptor which is used by hepatitis B virus (HBV) to infect the cells.
HBV viral particles were produced using the HepAD38 cell line. HepAD38 is a subclone, derived from HepG2 cell line, that expresses HBV genome (genotype D subtype ayw)

under the transcriptional control of a tetracycline-responsive promoter in a TET-OFF system.

A triple combination of Engineered Transcriptional Repressors (ETRs) consisting of three plasmids expressing dCas9-KRAB, dCas9-DNMT3A and dCas9-DNMT3L was used in combination with one or more of the designed sgRNAs.

LNPs were formulated using GENVOY ILM Lipid Mix (Precision Nanosystem) and the formulator Nanoassemblr Spark (Precision Nanosystem). LNPs were formulated according to the manufacturer's recommendations with Nitrogen:Phosphate (NP) ratio equal to 6 and flow rate ratio (FRR) 2:1. The RNA payload was diluted to a final concentration of 350 ng/uL in the PNI formulation buffer. The ETRs, dCas9-KRAB, dCas9-DNMT3A, dCas9-DNMT3L and each of the 121 sgRNA were mixed at 1:1:1:4 ratio. The RNA mix, the Genvoy lipid mix (25 mM) and PBS were loaded each in the dedicated chambers of the Spark cartridge and formulated. The quality of the formulated LNPs was evaluated quantifying the packaged mRNA using Quant-it™ RiboGreen RNA Assay Kit (Thermo Fisher) and sizing the LNP by Dynamic Light Scattering (Zetasizer, Malvern Panalytic).

HepG2-NTCP cells were plated at 20,000 cells/well in collagen coated 96 well plates. After 24 h cells were infected with HBV at 5,000 multiplicity of genome equivalent (MGE) and 16 h after viral inoculum was removed, cells were washed with PBS, and fresh media was added. Three days post-infection, using LNPs, each sgRNA and the mRNAs encoding each of the components of the triple constructs of ETRs (dCas9-KRAB, dCas9-DNMT3A, dCas9-DNMT3L) were delivered. Three days after, LNP was removed, medium was replaced, and cells were maintained in complete medium for three days.

Viral antigens HBeAg and HBsAg were quantified 6 days after LNP removal using ELISA assays. Data were normalized to a non-targeting guide designed against the mouse PCSK9 and control 3.2 gRNA was used as positive control. Cells viability assay were performed and normalized to non-targeting control.

The Table below provides amino acid sequences of exemplary epigenetic editors used in the gRNA screen (the ETR constructs):

TABLE 6 amino acid sequences of exemplary epigenetic editors

| SEQ ID NO | Description | Amino acid sequence |
|---|---|---|
| 476 | dCas9:G:KRAB | MYPYDVPDYASPKKKRKVEASDKKYSIGLAIGTNSVGWAVITDEYKVPSKKEK VLGNTDRHSIKKNLIGALLEDSGETAEATRLKRTARRRYTRRKNRICYLQEIF SNEMAKVDDSFFHRLEESFLVEEDKKHERHPIFGNIVDEVAYHEKYPTIYHLR KKLVDSTDKADLRLIYLALAHMIKERGHFLIEGDLNPDNSDVDKLFIQLVQTY NQLFEENPINASGVDAKAILSARLSKSRRLENLIAQLPGEKKNGLFGNLIALS LGLTPNFKSNEDLAEDAKLQLSKDTYDDDLDNLLAQIGDQYADLELAAKNLSD AILLSDILRVNTEITKAPLSASMIKRYDEHHQDLTLLKALVRQQLPEKYKEIF FDQSKNGYAGYIDGGASQEEFYKFIKPILEKMDGTEELLVKLNREDLLRKORT FDNGSIPHQIHLGELHAILRRQEDFYPFLKDNREKIEKILTFRIPYYVGPLAR GNSRFAWMTRKSEETITPWNFEEVVDKGASAQSFIERMTNEDKNLPNEKVLPK HSLLYEYFTVYNELTKVKYVTEGMRKPAFLSGEQKKAIVDLLFKTNRKVTVKQ LKEDYFKKIECFDSVEISGVEDRENASLGTYHDLLKIIKDKDELDNEENEDIL EDIVLTLTLFEDREMIEERLKTYAHLEDDKVMKQLKRRRYTGWGRLSRKLING IRDKQSGKTILDFLKSDGFANRNFMQLIHDDSLTFKEDIQKAQVSGQGDSLHE HIANLAGSPAIKKGILQTVKVVDELVKVMGRHKPENIVIEMARENQTTQKGQK NSRERMKRIEEGIKELGSQILKEHPVENTQLQNEKLYLYYLQNGRDMYVDQEL DINRLSDYDVDAIVPQSFLKDDSIDNKVLTRSDKNRGKSDNVPSEEVVKKMKN YWRQLLNAKLITQRKFDNLTKAERGGLSELDKAGFIKRQLVETRQITKHVAQI LDSRMNTKYDENDKLIREVKVITLKSKLVSDERKDFQFYKVREINNYHHAHDA YLNAVVGTALIKKYPKLESEFVYGDYKVYDVRKMIAKSEQEIGKATAKYFFYS NIMNFFKTEITLANGEIRKRPLIETNGETGEIVWDKGRDFATVRKVLSMPQVN IVKKTEVQTGGFSKESILPKRNSDKLIARKKDWDPKKYGGFDSPTVAYSVLVV AKVEKGKSKKLKSVKELLGITIMERSSFEKNPIDFLEAKGYKEVKKDLIIKLP KYSLFELENGRKRMLASAGELQKGNELALPSKYVNFLYLASHYEKLKGSPEDN EQKQLFVEQHKHYLDEIIEQISEFSKRVILADANLDKVLSAYNKHRDKPIREQ AENIIHLFTLTNLGAPAAFKYFDTTIDRKRYTSTKEVLDATLIHQSITGLYET RIDLSQLGGDSPKKKRKVGVDGSGGGALSPQHSAVTQGSIIKNKEGMDAKSLT AWSRTLVTFDVFVDETREEWKLLDTAQQIVYRNVMLENYKNLVSLGYQLTKP DVILRLEKGEEPWLVEREIHQETHPDSETAFEIKSSV* YPYDVPDYA - HA-Tag (SEQ ID NO: 479) GSGGG - Linker (SEQ ID NO: 480) |
| 477 | dCas9:G:DNMT3A | MYPYDVPDYASPKKKRKVEASDKKYSIGLAIGTNSVGWAVITDEYKVPSKKFK VLGNTDRHSIKKNLIGALLFDSGETAEATRLKRTARRRYTRRKNRICYLQEIF SNEMAKVDDSFFHRLEESFLVEEDKKHERHPIFGNIVDEVAYHEKYPTIYHLR KKLVDSTDKADLRLIYLALAHMIKFRGHFLIEGDLNPDNSDVDKLFIQLVQTY NQLFEENPINASGVDAKAILSARLSKSRRLENLIAQLPGEKKNGLEGNLIALS LGLTPNFKSNFDLAEDAKLQLSKDTYDDDLDNLLAQIGDQYADLFLAAKNLSD AILLSDILRVNTEITKAPLSASMIKRYDEHHQDLTLLKALVROQLPEKYKEIF FDQSKNGYAGYIDGGASQEEFYKFIKPILEKMDGTEELLVKLNREDLLRKORT FDNGSIPHQIHLGELHAILRRQEDFYPFLKDNREKIEKILTFRIPYYVGPLAR GNSRFAWMTRKSEETITPWNFEEVVDKGASAQSFIERMTNEDKNLPNEKVLPK HSLLYEYFTVYNELTKVKYVTEGMRKPAFLSGEQKKAIVDLLEKTNRKVTVKQ LKEDYFKKIECFDSVEISGVEDRENASLGTYHDLLKIIKDKDELDNEENEDIL EDIVLTLTLFEDREMIEERLKTYAHLEDDKVMKQLKRRRYTGWGRLSRKLING IRDKQSGKTILDELKSDGFANRNFMQLIHDDSLTFKEDIQKAQVSGQGDSLHE |

TABLE 6-continued amino acid sequences of exemplary epigenetic editors

| SEQ ID NO | Description | Amino acid sequence |
|---|---|---|
| | | HIANLAGSPAIKKGILQTVKVVDELVKVMGRHKPENIVIEMARENQTTQKGQK<br>NSRERMKRIEEGIKELGSQILKEHPVENTQLQNEKLYLYYLQNGRDMYVDQEL<br>DINRLSDYDVDAIVPQSFLKDDSIDNKVLTRSDKNRGKSDNVPSEEVVKKMKN<br>YWRQLLNAKLITQRKFDNLTKAERGGLSELDKAGFIKRQLVETRQITKHVAQI<br>LDSRMNTKYDENDKLIREVKVITLKSKLVSDFRKDFQFYKVREINNYHHAHDA<br>YLNAVVGTALIKKYPKLESEFVYGDYKVYDVRKMIAKSEQEIGKATAKYFFYS<br>NIMNFFKTEITLANGEIRKRPLIETNGETGEIVWDKGRDFATVRKVLSMPQVN<br>IVKKTEVQTGGFSKESILPKRNSDKLIARKKDWDPKKYGGEDSPTVAYSVLVV<br>AKVEKGKSKKLKSVKELLGITIMERSSFEKNPIDFLEAKGYKEVKKDLIIKLP<br>KYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQ<br>AENIIHLFTLTNLGAPAAFKYFDTTIDRKRYTSTKEVLDATLIHQSITGLYET<br>RIDLSQLGGDSPKKKRKVGVDGSGGGTYGLLRRREDWPSRLQMFFANNHDQEF<br>DPPKVYPPVPAEKRKPIRVLSLEDGIATGLLVLKDLGIQVDRYIASEVCEDSI<br>TVGMVRHQGKIMYVGDVRSVTQKHIQEWGPFDLVIGGSPCNDLSIVNPARKGL<br>YEGTGRLFFEFYRLLHDARPKEGDDRPFFWLFENVVAMGVSDKRDISRFLESN<br>PVMIDAKEVSAAHRARYFWGNLPGMNRPLASTVNDKLELQECLEHGRIAKESK<br>VRTITTRSNSIKQGKDQHFPVFMNEKEDILWCTEMERVFGFPVHYTDVSNMSR<br>LARQRLLGRSWSVPVIRHLFAPLKEYFACV*<br>YPYDVPDYA - HA-Tag (SEQ ID NO: 479)<br>GSGGG - Linker (SEQ ID NO: 480) |
| 478 | dCas9:G:hDNMT3L | MYPYDVPDYASPKKKRKVEASDKKYSIGLAIGTNSVGWAVITDEYKVPSKKEK<br>VLGNTDRHSIKKNLIGALLFDSGETAEATRLKRTARRRYTRRKNRICYLQEIF<br>SNEMAKVDDSFFHRLEESFLVEEDKKHERHPIFGNIVDEVAYHEKYPTIYHLR<br>KKLVDSTDKADLRLIYLALAHMIKFRGHFLIEGDLNPDNSDVDKLFIQLVQTY<br>NQLFEENPINASGVDAKAILSARLSKSRRLENLIAQLPGEKKNGLFGNLIALS<br>LGLTPNFKSNFDLAEDAKLQLSKDTYDDDLDNLLAQIGDQYADLFLAAKNLSD<br>AILLSDILRVNTEITKAPLSASMIKRYDEHHQDLTLLKALVRQQLPEKYKEIF<br>FDQSKNGYAGYIDGGASQEEFYKFIKPILEKMDGTEELLVKLNREDLLRKQRT<br>FDNGSIPHQIHLGELHAILRRQEDFYPELKDNREKIEKILTFRIPYYVGPLAR<br>GNSRFAWMTRKSEETITPWNFEEVVDKGASAQSFIERMTNFDKNLPNEKVLPK<br>HSLLYEYFTVYNELTKVKYVTEGMRKPAFLSGEQKKAIVDLLFKTNRKVTVKQ<br>LKEDYFKKIECFDSVEISGVEDRENASLGTYHDLLKIIKDKDFLDNEENEDIL<br>EDIVLTLTLFEDREMIEERLKTYAHLFDDKVMKQLKRRRYTGWGRLSRKLING<br>IRDKQSGKTILDELKSDGFANRNFMQLIHDDSLTFKEDIQKAQVSGQGDSLHE<br>HIANLAGSPAIKKGILQTVKVVDELVKVMGRHKPENIVIEMARENQTTQKGQK<br>NSRERMKRIEEGIKELGSQILKEHPVENTQLQNEKLYLYYLQNGRDMYVDQEL<br>DINRLSDYDVDAIVPQSFLKDDSIDNKVLTRSDKNRGKSDNVPSEEVVKKMKN<br>YWRQLLNAKLITQRKFDNLTKAERGGLSELDKAGFIKRQLVETRQITKHVAQI<br>LDSRMNTKYDENDKLIREVKVITLKSKLVSDERKDFQFYKVREINNYHHAHDA<br>YLNAVVGTALIKKYPKLESEFVYGDYKVYDVRKMIAKSEQEIGKATAKYFFYS<br>NIMNFFKTEITLANGEIRKRPLIETNGETGEIVWDKGRDFATVRKVLSMPQVN<br>IVKKTEVQTGGFSKESILPKRNSDKLIARKKDWDPKKYGGEDSPTVAYSVLVV<br>AKVEKGKSKKLKSVKELLGITIMERSSFEKNPIDFLEAKGYKEVKKDLIIKLP<br>KYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQ<br>AENIIHLFTLTNLGAPAAFKYEDTTIDRKRYTSTKEVLDATLIHQSITGLYET<br>RIDLSQLGGDSPKKKRKVGVDGSGGGMAAIPALDPEAEPSMDVILVGSSELSS<br>SVSPGTGRDLIAYEVKANQRNIEDICICCGSLQVHTQHPLFEGGICAPCKDKF<br>LDALFLYDDDGYQSYCSICCSGETLLICGNPDCTRCYCFECVDSLVGPGTSGK<br>VHAMSNWVCYLCLPSSRSGLLQRRRKWRSQLKAFYDRESENPLEMFETVPVWR<br>RQPVRVLSLFEDIKKELTSLGFLESGSDPGQLKHVVDVTDTVRKDVEEWGPED<br>LVYGATPPLGHTCDRPPSWYLFQFHRLLQYARPKPGSPRPFFWMFVDNLVLNK<br>EDLDVASRFLEMEPVTIPDVHGGSLQNAVRVWSNIPAIRSRHWALVSEEELSL<br>LAQNKQSSKLAAKWPTKLVKNCELPLREYFKYFSTELTSSL*<br>YPYDVPDYA - HA-Tag (SEQ ID NO: 479)<br>GSGGG - Linker (SEQ ID NO: 480) |
| 479 | HA-Tag | YPYDVPDYA |
| 480 | linker | GSGGG |

The Table below provides amino acid sequences and polynucleotide sequences of exemplary epigenetic editors

TABLE 7 sequences of exemplary epigenetic editors

| SEQ ID NO | Description | Sequence |
| --- | --- | --- |
| 481 | PLA001 amino acid sequence | MPKKKRKVPKKKRKVYNHDQEFDPPKVYPPVPAEKRKPIRVLSLEDGIATG
LLVLKDLGIQVDRYIASEVCEDSITVGMVRHQGKIMYVGDVRSVTQKHIQE
WGPFDLVIGGSPCNDLSIVNPARKGLYEGTGRLFFEFYRLLHDARPKEGDD
RPFFWLFENVVAMGVSDKRDISRFLESNPVMIDAKEVSAAHRARYFWGNLP
GMNRPLASTVNDKLELQECLEHGRIAKFSKVRTITTRSNSIKQGKDQHFPV
FMNEKEDILWCTEMERVFGFPVHYTDVSNMSRLARQRLLGRSWSVPVIRHL
FAPLKEYFACVSSGNSNANSRGPSESSGLVPLSLRGSHMAAIPALDPEAEP
SMDVILVGSSELSSSVSPGTGRDLIAYEVKANQRNIEDICICCGSLQVHTQ
HPLFEGGICAPCKDKFLDALFLYDDDGYQSYCSICCSGETLLICGNPDCTR
CYCFECVDSLVGPGTSGKVHAMSNWVCYLCLPSSRSGLLQRRRKWRSQLKA
FYDRESENPLEMFETVPVWRRQPVRVLSLFEDIKKELTSLGFLESGSDPGQ
LKHVVDVTDTVRKDVEEWGPFDLVYGATPPLGHTCDRPPSWYLFQFHRLLQ
YARPKPGSPRPFFWMFVDNLVLNKEDLDVASRFLEMEPVTIPDVHGGSLQN
AVRVWSNIPAIRSRHWALVSEEELSLLAQNKQSSKLAAKWPTKLVKNCFLP
LREYFKYFSTELTSSLGGPSSGAPPPSGGSPAGSPTSTEEGTSESATPESG
PGTSTEPSEGSAPGSPAGSPTSTEEGTSTEPSEGSAPGTSTEPSELEDKKY
SIGLAIGTNSVGWAVITDEYKVPSKKFKVLGNTDRHSIKKNLIGALLEDSG
ETAEATRLKRTARRRYTRRKNRICYLQEIFSNEMAKVDDSFFHRLEESELV
EEDKKHERHPIFGNIVDEVAYHEKYPTIYHLRKKLVDSTDKADLRLIYLAL
AHMIKFRGHFLIEGDLNPDNSDVDKLFIQLVQTYNQLFEENPINASGVDAK
AILSARLSKSRRLENLIAQLPGEKKNGLFGNLIALSLGLTPNEKSNEDLAE
DAKLQLSKDTYDDDLDNLLAQIGDQYADLFLAAKNLSDAILLSDILRVNTE
ITKAPLSASMIKRYDEHHQDLTLLKALVRQQLPEKYKEIFFDQSKNGYAGY
IDGGASQEEFYKFIKPILEKMDGTEELLVKLNREDLLRKQRTEDNGSIPHQ
IHLGELHAILRRQEDFYPFLKDNREKIEKILTFRIPYYVGPLARGNSRFAW
MTRKSEETITPWNFEEVVDKGASAQSFIERMTNEDKNLPNEKVLPKHSLLY
EYFTVYNELTKVKYVTEGMRKPAFLSGEQKKAIVDLLEKTNRKVTVKQLKE
DYFKKIECFDSVEISGVEDRENASLGTYHDLLKIIKDKDELDNEENEDILE
DIVLTLTLFEDREMIEERLKTYAHLEDDKVMKQLKRRRYTGWGRLSRKLIN
GIRDKQSGKTILDELKSDGFANRNFMQLIHDDSLTFKEDIQKAQVSGQGDS
LHEHIANLAGSPAIKKGILQTVKVVDELVKVMGRHKPENIVIEMARENQTT
QKGQKNSRERMKRIEEGIKELGSQILKEHPVENTQLQNEKLYLYYLQNGRD
MYVDQELDINRLSDYDVDAIVPQSFLKDDSIDNKVLTRSDKNRGKSDNVPS
EEVVKKMKNYWRQLLNAKLITQRKEDNLTKAERGGLSELDKAGFIKRQLVE
TRQITKHVAQILDSRMNTKYDENDKLIREVKVITLKSKLVSDERKDFQFYK
VREINNYHHAHDAYLNAVVGTALIKKYPKLESEFVYGDYKVYDVRKMIAKS
EQEIGKATAKYFFYSNIMNFFKTEITLANGEIRKRPLIETNGETGEIVWDK
GRDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALP
SKYVNFLYLASHYEKLKGSPEDNEQKQLFVEQHKHYLDEIIEQISEFSKRV
ILADANLDKVLSAYNKHRDKPIREQAENIIHLFTLTNLGAPAAFKYEDTTI
DRKRYTSTKEVLDATLIHQSITGLYETRIDLSQLGGDSPKKKRKVGVDGSS
GSETPGTSESATPESTGDSVAFEDVAVNETLEEWALLDPSQKNLYRDVMRE
TFRNLASVGKQWEDQNIEDPFKIPRRNISHIPERLCESKEGGQGEESADYK
DDDDKAPKKKRKVPKKKRKV |
| 482 | PLA001 polynucleotide sequence | ATGCCAAAAAAGAAGAGAAAGGTACCGAAGAAAAAAGAAAGGTATACAAT
CACGATCAGGAGTTCGACCCCCCTAAGGTGTACCCACCAGTGCCTGCAGAG
AAGAGGAAGCCAATCCGGGTGCTGAGCCTGTTTGATGGCATCGCCACCGGC
CTGCTGGTGCTGAAGGATCTGGGCATCCAGGTGGACCGGTACATCGCCTCC
GAGGTGTGCGAGGATTCTATCACCGTGGGCATGGTCGCCACCAGGGCAAG
ATCATGTATGTGGGCGACGTGCGGTCCGTGACACAGAAGCACATCCAGGAG
TGGGGCCCATTCGATCTGGTGATCGGCGGCAGCCCCTGTAATGACCTGTCC
ATCGTGAACCCTGCAAGGAAGGGACTGTACGAGGGAACCGGCCGGCTGTTC
TTTGAGTTTTATAGACTGCTGCACGACGCCAGGCCTAAGGAGGGCGACGAT
AGACCATTCTTTTGGCTGTTCGAGAATGTGGTGGCTATGGGCGTGAGCGAT
AAGAGGGACATCTCCAGGTTTCTGGAGTCTAACCCCGTGATGATCGATGCA
AAGGAGGTGTCCGCCGCACACAGAGCCAGGTATTTCTGGGGCAATCTGCCA
GGAATGAACAGGCCACTGGCAAGCACCGTGAATGACAAGCTGGAGCTGCAG
GAGTGCCTGGAGCACGGAAGGATCGCCAAGTTTTCCAAGGTGCGCACAATC
ACCACACGGAGCAATTCCATCAAGCAGGGCAAGGATCAGCACTTCCCCGTG
TTCATGAACGAGAAGGAGGACATCCTGTGGTGTACCGAGATGGAGAGAGTG
TTCGGCTTTCCAGTGCACTACACAGACGTGTCTAACATGAGCAGGCTGGCA
AGGCAGCGGCTGCTGGGCAGATCTTGGAGCGTGCCCGTGATCAGGCACCTG
TTCGCCCCTCTGAAGGAGTATTTTGCCTGCGTGAGCAGCGGCAACTCCAAT
GCCAACAGCCGGGGCCCCTCTTTCAGCTCCGGATTGGTGCCTCTGAGCCTG
AGGGGCTCCCACATGGCAGCAATCCCCGCCCTGGACCCCGAGGCCGAGCCT
AGCATGGACGTGATCCTGGTGGGCTCTAGCGAGCTGTCCTCTAGCGTGTCT
CCAGGAACCGGAAGGGATCTGATCGCATACGAGGTGAAGGCCAATCAGCGG
AACATCGAGGACATCTGTATCTGCTGTGGCAGCCTGCAGGTGCACACACAG
CACCCACTGTTCGAGGGGAGGAATCTGCGCACCCTGTAAGGATAAGTTCCTG |

TABLE 7-continued sequences of exemplary epigenetic editors

| SEQ ID NO | Description | Sequence |
|---|---|---|
| | | GACGCCCTGTTTCTGTACGACGATGACGGCTACCAGTCCTATTGCTCTATC
TGCTGTTCCGGCGAGACCCTGCTGATCTGCGGCAATCCAGATTGTACAAGG
TGCTATTGTTTTGAGTGCGTGGACTCTCTGGTGGGACCAGGCACCAGCGGA
AAGGTGCACGCCATGTCCAACTGGGTGTGCTACCTGTGCCTGCCATCCTCT
CGCAGCGGACTGCTGCAGCGGAGAAGGAAGTGGAGATCCCAGCTGAAGGCC
TTCTATGATAGGGAGTCTGAGAACCCCCTGGAGATGTTTGAGACCGTGCCA
GTGTGGCGCCGGCAGCCCGTGAGGGTGCTGAGCCTGTTCGAGGATATCAAG
AAGGAGCTGACATCCCTGGGCTTTCTGGAGTCCGGCTCTGACCCCGGACAG
CTGAAGCACGTGGTGGATGTGACCGACACAGTGCGGAAGGATGTGGAGGAG
TGGGGCCCTTTCGACCTGGTGTACGGAGCAACCCCTCCACTGGGACACACA
TGCGACAGACCCCCTTCTTGGTACCTGTTCCAGTTTCACCGCCTGCTGCAG
TATGCAAGGCCAAAGCCAGGCAGCCCTAGACCATTCTTTTGGATGTTCGTG
GATAATCTGGTGCTGAACAAGGAGGATCTGGACGTGGCCAGCAGGTTTCTG
GAGATGGAGCCAGTGACCATCCCAGACGTGCACGGCGGCTCCCTGCAGAAT
GCCGTGCGCGTGTGGTCTAACATCCCTGCCATCAGAAGCAGGCACTGGGCA
CTGGTGAGCGAGGAGGAGCTGTCCCTGCTGGCCCAGAATAAGCAGAGCAGC
AAGCTGGCCGCCAAGTGGCCTACAAAGCTGGTGAAGAACTGCTTCCTGCCA
CTGCGGGAGTACTTCAAGTATTTTTCCACCGAGCTGACATCTAGCCTGGGA
GGACCCTCCTCTGGCGCCCCACCACCTAGCGGCGGCTCCCCTGCCGGCTCT
CCAACCAGCACAGAGGAGGGCACCAGCGAGTCCGCCACACCAGAGTCTGGA
CCTGGCACCAGCACAGAGCCATCCGAGGGCTCTGCCCCAGGCTCTCCTGCA
GGCAGCCCTACCTCCACCGAAGAGGGCACCAGCACAGAGCCTTCTGAGGGC
AGCGCCCCAGGCACCTCTACAGAGCCAAGCGAGCTCGAGGACAAGAAGTAC
AGCATCGGCCTGGCCATCGGCACCAACTCTGTGGGCTGGGCCGTGATCACC
GACGAGTACAAGGTGCCCAGCAAGAAATTCAAGGTGCTGGGCAACACCGAC
CGGCACAGCATCAAGAAGAACCTGATCGGAGCCCTGCTGTTCGACAGCGGC
GAAACAGCCGAGGCCACCCGGCTGAAGAGAACCGCCAGAAGAAGATACACC
AGACGGAAGAACCGGATCTGCTATCTGCAAGAGATCTTCAGCAACGAGATG
GCCAAGGTGGACGACAGCTTCTTCCACAGACTGGAAGAGTCCTTCCTGGTG
GAAGAGGATAAGAAGCACGAGCGGCACCCCATCTTCGGCAACATCGTGGAC
GAGGTGGCCTACCACGAGAAGTACCCCACCATCTACCACCTGAGAAAGAAA
CTGGTGGACAGCACCGACAAGGCCGACCTGCGGCTGATCTATCTGGCCCTG
GCCCACATGATCAAGTTCCGGGGCCACTTCCTGATCGAGGGCGACCTGAAC
CCCGACAACAGCGACGTGGACAAGCTGTTCATCCAGCTGGTGCAGACCTAC
AACCAGCTGTTCGAGGAAAACCCCATCAACGCCAGCGGCGTGGACGCCAAG
GCCATCCTGTCTGCCAGACTGAGCAAGAGCAGACGGCTGGAAAATCTGATC
GCCCAGCTGCCCGGCGAGAAGAATGGCCTGTTCGGCAACCTGATTGCC
CTGAGCCTGGGCCTGACCCCCAACTTCAAGAGCAACTTCGACCTGGCCGAG
GATGCCAAACTGCAGCTGAGCAAGGACACCTACGACGACGACCTGGACAAC
CTGCTGGCCCAGATCGGCGACCAGTACGCCGACCTGTTTCTGGCCGCCAAG
AACCTGTCCGACGCCATCCTGCTGAGCGACATCCTGAGAGTGAACACCGAG
ATCACCAAGGCCCCCCTGAGCGCCTCTATGATCAAGAGATACGACGAGCAC
CACCAGGACCTGACCCTGCTGAAAGCTCTCGTGCGGCAGCAGCTGCCTGAG
AAGTACAAAGAGATTTTCTTCGACCAGAGCAAGAACGGCTACGCCGGCTAC
ATTGACGGCGGAGCCAGCCAGGAAGAGTTCTACAAGTTCATCAAGCCCATC
CTGGAAAAGATGGACGGCACCGAGGAACTGCTCGTGAAGCTGAACAGAGAG
GACCTGCTGCGGAAGCAGCGGACCTTCGACAACGGCAGCATCCCCCACCAG
ATCCACCTGGGAGAGCTGCACGCCATTCTGCGGCGGCAGGAAGATTTTTAC
CCATTCCTGAAGGACAACCGGGAAAAGATCGAGAAGATCCTGACCTTCCGC
ATCCCCTACTACGTGGGCCCTCTGGCCAGGGGAAACAGCAGATTCGCCTGG
ATGACCAGAAAGAGCGAGGAAACCATCACCCCCTGGAACTTCGAGGAAGTG
GTGGACAAGGGCGCTTCCGCCCAGAGCTTCATCGAGCGGATGACCAACTTC
GATAAGAACCTGCCCAACGAGAAGGTGCTGCCCAAGCACAGCCTGCTGTAC
GAGTACTTCACCGTGTATAACGAGCTGACCAAAGTGAAATACGTGACCGAG
GGAATGAGAAAGCCCGCCTTCCTGAGCGGCGAGCAGAAAAAGGCCATCGTG
GACCTGCTGTTCAAGACCAACCGGAAAGTGACCGTGAAGCAGCTGAAAGAG
GACTACTTCAAGAAAATCGAGTGCTTCGACTCCGTGGAAATCTCCGGCGTG
GAAGATCGGTTCAACGCCTCCCTGGGCACATACCACGATCTGCTGAAAATT
ATCAAGGACAAGGACTTCCTGGACAATGAGGAAAACGAGGACATTCTGGAA
GATATCGTGCTGACCCTGACACTGTTTGAGGACAGAGAGATGATCGAGGAA
CGGCTGAAAACCTATGCCCACCTGTTCGACGACAAAGTGATGAAGCAGCTG
AAGCGGCGGAGATACACCGGCTGGGGCAGGCTGAGCCGGAAGCTGATCAAC
GGCATCCGGGACAAGCAGTCCGGCAAGACAATCCTGGATTTCCTGAAGTCC
GACGGCTTCGCCAACAGAAACTTCATGCAGCTGATCCACGACGACAGCCTG
ACCTTTAAAGAGGACATCCAGAAAGCCCAGGTGTCCGGCCAGGGCGATAGC
CTGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCGG
CACAAGCCCGAGAACATCGTGATCGAAATGGCCAGAGAGAACCAGACCACC
CAGAAGGGACAGAAGAACAGCCGCGAGAGAATGAAGCGGATCGAAGAGGGC
ATCAAAGAGCTGGGCAGCCAGATCCTGAAAGAACACCCCGTGGAAAACACC
CAGCTGCAGAACGAGAAGCTGTACCTGTACTACCTGCAGAATGGGCGGGAT
ATGTACGTGGACCAGGAACTGGACATCAACCGGCTGTCCGACTACGATGTG
GACGCCATCGTGCCTCAGAGCTTTCTGAAGGACGACTCCATCGACAACAAG
GTGCTGACCAGAAGCGACAAGAACCGGGGCAAGAGCGACAACGTGCCCTCC
GAAGAGGTCGTGAAGAAGATGAAGAACTACTGGCGGCAGCTGCTGAACGCC |

TABLE 7-continued sequences of exemplary epigenetic editors

| SEQ ID NO | Description | Sequence |
|---|---|---|
| | | AAGCTGATTACCCAGAGAAAGTTCGACAATCTGACCAAGGCCGAGAGAGGC<br>GGCCTGAGCGAACTGGATAAGGCCGGCTTCATCAAGAGACAGCTGGTGGAA<br>ACCCGGCAGATCACAAAGCACGTGGCACAGATCCTGGACTCCCGGATGAAC<br>ACTAAGTACGACGAGAATGACAAGCTGATCCGGGAAGTGAAAGTGATCACC<br>CTGAAGTCCAAGCTGGTGTCCGATTTCCGGAAGGATTTCCAGTTTTACAAA<br>GTGCGCGAGATCAACAACTACCACCACGCCCACGACGCCTACCTGAACGCC<br>GTCGTGGGAACCGCCCTGATCAAAAAGTACCCTAAGCTGGAAAGCGAGTTC<br>GTGTACGGCGACTACAAGGTGTACGACGTGCGGAAGATGATCGCCAAGAGC<br>GAGCAGGAAATCGGCAAGGCTACCGCCAAGTACTTCTTCTACAGCAACATC<br>ATGAACTTTTTCAAGACCGAGATTACCCTGGCCAACGGCGAGATCCGGAAG<br>CGGCCTCTGATCGAGACAAACGGCGAAACCGGGGAGATCGTGTGGGATAAG<br>GGCCGGGATTTTGCCACCGTGCGGAAAGTGCTGAGCATGCCCCAAGTGAAT<br>ATCGTGAAAAAGACCGAGGTGCAGACAGGCGGCTTCAGCAAAGAGTCTATC<br>CTGCCCAAGAGGAACAGCGATAAGCTGATCGCCAGAAAGAAGGACTGGGAC<br>CCTAAGAAGTACGGCGGCTTCGACAGCCCCACCGTGGCCTATTCTGTGCTG<br>GTGGTGGCCAAAGTGGAAAAGGGCAAGTCCAAGAAACTGAAGAGTGTGAAA<br>GAGCTGCTGGGGATCACCATCATGGAAAGAAGCAGCTTCGAGAAGAATCCC<br>ATCGACTTTCTGGAAGCCAAGGGCTACAAAGAAGTGAAAAAGGACCTGATC<br>ATCAAGCTGCCTAAGTACTCCCTGTTCGAGCTGGAAAACGGCCGGAAGAGA<br>ATGCTGGCCTCTGCCGGCGAACTGCAGAAGGGAAACGAACTGGCCCTGCCC<br>TCCAAATATGTGAACTTCCTGTACCTGGCCAGCCACTATGAGAAGCTGAAG<br>GGCTCCCCCGAGGATAATGAGCAGAAACAGCTGTTTGTGGAACAGCACAAG<br>CACTACCTGGACGAGATCATCGAGCAGATCAGCGAGTTCTCCAAGAGAGTG<br>ATCCTGGCCGACGCTAATCTGGACAAAGTGCTGTCCGCCTACAACAAGCAC<br>CGGGATAAGCCCATCAGAGAGCAGGCCGAGAATATCATCCACCTGTTTACC<br>CTGACCAATCTGGGAGCCCCTGCCGCCTTCAAGTACTTTGACACCACCATC<br>GACCGGAAGAGGTACACCAGCACCAAAGAGGTGCTGGACGCCACCCTGATC<br>CACCAGAGCATCACCGGCCTGTACGAGACACGGATCGACCTGTCTCAGCTG<br>GGAGGCGACAGCCCCAAGAAGAAGAGAAAGGTGGGAGTCGACGGATCCAGC<br>GGCTCCGAGACCCCAGGCACATCTGAGAGCGCCACCCCTGAGTCCACCGGT<br>GACTCCGTTGCTTTCGAGGACGTGGCCGTGAACTTCACACTTGAGGAATGG<br>GCCTTGCTCGACCCAAGTCAGAAGAATCTGTACAGAGACGTGATGCGGGAG<br>ACATTCAGGAATCTCGCAGTGTCGGAAAGCAGTGGGAAGACCAGAACATC<br>GAAGATCCTTTCAAGATACCACGGCGCAATATCTCCCACATTCCTGAGAGG<br>CTGTGTGAATCTAAGGAAGGCGGACAAGGTGAGGAAAGCGCTGATTACAAA<br>GATGATGACGATAAAGCCCCCAAGAAGAAAAGGAAGGTCCCAAAGAAAAAA<br>AGAAAGGTGTGA |
| 483 | PLA002<br>Amino acid<br>sequence | MPKKKRKVPKKKRKVYNHDQEFDPPKVYPPVPAEKRKPIRVLSLEDGIATG<br>LLVLKDLGIQVDRYIASEVCEDSITVGMVRHQGKIMYVGDVRSVTQKHIQE<br>WGPFDLVIGGSPCNDLSIVNPARKGLYEGTGRLFFEFYRLLHDARPKEGDD<br>RPFFWLFENVVAMGVSDKRDISRFLESNPVMIDAKEVSAAHRARYFWGNLP<br>GMNRPLASTVNDKLELQECLEHGRIAKFSKVRTITTRSNSIKQGKDQHFPV<br>FMNEKEDILWCTEMERVFGFPVHYTDVSNMSRLARQRLLGRSWSVPVIRHL<br>FAPLKEYFACVSSGNSNANSRGPSFSSGLVPLSLRGSHMAAIPALDPEAEP<br>SMDVILVGSSELSSSVSPGTGRDLIAYEVKANQRNIEDICICCGSLQVHTQ<br>HPLFEGGICAPCKDKFLDALFLYDDDGYQSYCSICCSGETLLICGNPDCTR<br>CYCFECVDSLVGPGTSGKVHAMSNWVCYLCLPSSRSGLLQRRRKWRSQLKA<br>FYDRESENPLEMFETVPVWRRQPVRVLSLFEDIKKELTSLGFLESGSDPGQ<br>LKHVVDVTDTVRKDVEEWGPFDLVYGATPPLGHTCDRPPSWYLFQFHRLLQ<br>YARPKPGSPRPFFWMFVDNLVLNKEDLDVASRFLEMEPVTIPDVHGGSLQN<br>AVRVWSNIPAIRSRHWALVSEEELSLLAQNKQSSKLAAKWPTKLVKNCFLP<br>LREYFKYFSTELTSSLGGPSSGAPPPSGGSPAGSPTSTEEGTSESATPESG<br>PGTSTEPSEGSAPGSPAGSPTSEEGTSTEPSEGSAPGTSTEPSELEDKKY<br>SIGLAIGTNSVGWAVITDEYKVPSKKFKVLGNTDRHSIKKNLIGALLEDSG<br>ETAEATRLKRTARRRYTRRKNRICYLQEIFSNEMAKVDDSFFHRLEESELV<br>EEDKKHERHPIFGNIVDEVAYHEKYPTIYHLRKKLVDSTDKADLRLIYLAL<br>AHMIKFRGHFLIEGDLNPDNSDVDKLFIQLVQTYNQLFEENPINASGVDAK<br>AILSARLSKSRRLENLIAQLPGEKKNGLEGNLIALSLGLTPNEKSNEDLAE<br>DAKLQLSKDTYDDDLDNLLAQIGDQYADLFLAAKNLSDAILLSDILRVNTE<br>ITKAPLSASMIKRYDEHHQDLTLLKALVRQQLPEKYKEIFFDQSKNGYAGY<br>IDGGASQEEFYKFIKPILEKMDGTEELLVKLNREDLLRKQRTEDNGSIPHQ<br>IHLGELHAILRRQEDFYPFLKDNREKIEKILTFRIPYYVGPLARGNSRFAW<br>MTRKSEETITPWNFEEVVDKGASAQSFIERMTNEDKNLPNEKVLPKHSLLY<br>EYFTVYNELTKVKYVTEGMRKPAFLSGEQKKAIVDLLEKTNRKVTVKQLKE<br>DYFKKIECFDSVEISGVEDRENASLGTYHDLLKIIKDKDELDNEENEDILE<br>DIVLTLTLFEDREMIEERLKTYAHLEDDKVMKQLKRRRYTGWGRLSRKLIN<br>GIRDKQSGKTILDELKSDGFANRNEMQLIHDDSLTFKEDIQKAQVSGQGDS<br>LHEHIANLAGSPAIKKGILQTVKVVDELVKVMGRHKPENIVIEMARENQTT<br>QKGQKNSRERMKRIEEGIKELGSQILKEHPVENTQLQNEKLYLYLQNGRD<br>MYVDQELDINRLSDYDVDAIVPQSFLKDDSIDNKVLTRSDKNRGKSDNVPS<br>EEVVKKMKNYWRQLLNAKLITQRKEDNLTKAERGGLSELDKAGFIKRQLVE<br>TRQITKHVAQILDSRMNTKYDENDKLIREVKVITLKSKLVSDERKDFQYK<br>VREINNYHHAHDAYLNAVVGTALIKKYPKLESEFVYGDYKVYDVRKMIAKS<br>EQEIGKATAKYFFYSNIMNFFKTEITLANGEIRKRPLIETNGETGEIVWDK |

TABLE 7-continued sequences of exemplary epigenetic editors

| SEQ ID NO | Description | Sequence |
|---|---|---|
| | | GRDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALP
SKYVNFLYLASHYEKLKGSPEDNEQKQLFVEQHKHYLDEIIEQISEFSKRV
ILADANLDKVLSAYNKHRDKPIREQAENIIHLFTLTNLGAPAAFKYEDTTI
DRKRYTSTKEVLDATLIHQSITGLYETRIDLSQLGGDSPKKKRKVGVDGSS
GSETPGTSESATPESTGMNNSQGRVTFEDVTVNFTQGEWQRLNPEQRNLYR
DVMLENYSNLVSVGQGETTKPDVILRLEQGKEPWLEEEEVLGSGRAEKNGD
IGGQIWKPKDVKESLSADYKDDDDKAPKKKRKVPKKKRKV |
| 484 | PLA002 polynucleotide sequence | ATGCCAAAAAAGAAGAGAAAGGTACCGAAGAAAAAAGAAAGGTATACAAT
CACGATCAGGAGTTCGACCCCCCTAAGGTGTACCCACCAGTGCCTGCAGAG
AAGAGGAAGCCAATCCGGGTGCTGAGCCTGTTTGATGGCATCGCCACCGGC
CTGCTGGTGCTGAAGGATCTGGGCATCCAGGTGGACCGGTACATCGCCTCC
GAGGTGTGCGAGGATTCTATCACCGTGGGCATGGTGCGCCACCAGGGCAAG
ATCATGTATGTGGGCGACGTCGGTCCGTGACACAGAAGCACATCCAGGAG
TGGGGCCCATTCGATCTGGTGATCGGCGGCAGCCCCTGTAATGACCTGTCC
ATCGTGAACCCTGCAAGGAAGGGACTGTACGAGGGAACCGGCCGGCTGTTC
TTTGAGTTTTATAGACTGCTGCACGACGCCAGGCCTAAGGAGGGCGACGAT
AGACCATTCTTTTGGCTGTTCGAGAATGTGGTGGCTATGGGCGTGAGCGAT
AAGAGGGACATCTCCAGGTTTCTGGAGTCTAACCCCGTGATGATCGATGCA
AAGGAGGTGTCCGCCGCACACAGAGCCAGGTATTTCTGGGGCAATCTGCCA
GGAATGAACAGGCCACTGGCAAGCACCGTGAATGACAAGCTGGAGCTGCAG
GAGTGCCTGGAGCACGAAGGATCGCCAAGTTTTCCAAGGTGCGCACAATC
ACCACACGGAGCAATTCCATCAAGCAGGGCAAGGATCAGCACTTCCCCGTG
TTCATGAACGAGAAGGAGGACATCCTGTGGTGTACCGAGATGGAGAGTG
TTCGGCTTTCCAGTGCACTACACAGACGTGTCTAACATGAGCAGGCTGGCA
AGGCAGCGGCTGCTGGGCAGATCTTGGAGCGTGCCCGTGATCAGGCACCTG
TTCGCCCCTCTGAAGGAGTATTTTGCCTGCGTGAGCAGCGGCAACTCCAAT
GCCAACAGCCGGGGCCCCTCTTTCAGCTCCGGATTGGTGCCTCTGAGCCTG
AGGGGCTCCCACATGGCAGCAATCCCCGCCCTGGACCCCGAGGCCGAGCCT
AGCATGGACGTGATCCTGGTGGGCTCTAGCGAGCTGTCCTCTAGCGTGTCT
CCAGGAACCGGAAGGGATCTGATCGCATACGAGGTGAAGGCCAATCAGCGG
AACATCGAGGACATCTGTATCTGCTGTGGCAGCCTGCAGGTGCACACACAG
CACCCACTGTTCGAGGGAGGAATCTGCGCACCCTGTAAGGATAAGTTCCTG
GACGCCCTGTTTCTGTACGACGATGACGGCTACCAGTCCTATTGCTCTATC
TGCTGTTCCGGCGAGACCCTGCTGATCTGCGGCAATCCAGATTGTACAAGG
TGCTATTGTTTTGAGTGCGTGGACTCTCTGGTGGGACCAGGCACCAGCGGA
AAGGTGCACGCCATGTCCAACTGGGTGTGCTACCTGTGCCTGCCATCCTCT
CGCAGCGGACTGCTGCAGCGGAGAAGGAAGTGGAGATCCCAGCTGAAGGCC
TTCTATGATAGGGAGTCTGAGAACCCCCTGGAGATGTTTGAGACCGTGCCA
GTGTGGCGCCGGCAGCCCGTGAGGGTGCTGAGCCTGTTCGAGGATATCAAG
AAGGAGCTGACATCCCTGGGCTTTCTGGAGTCCGGCTCTGACCCCGGACAG
CTGAAGCACGTGGTGGATGTGACCGACACAGTGCGGAAGGATGTGGAGGAG
TGGGGCCCTTTCGACCTGGTGTACGGAGCAACCCCTCCACTGGGACACACA
TGCGACAGACCCCCTTCTTGGTACCTGTTCCAGTTTCACCGCCTGCTGCAG
TATGCAAGGCCAAAGCCAGGCAGCCCTAGACCATTCTTTTGGATGTTCGTG
GATAATCTGGTGCTGAACAAGGAGGATCTGGACGTGGCCAGCAGGTTTCTG
GAGATGGAGCCAGTGACCATCCCAGACGTGCACGGCGGCTCCCTGCAGAAT
GCCGTGCGCGTGTGGTCTAACATCCCTGCCATCAGAAGCAGGCACTGGGCA
CTGGTGAGCGAGGAGGAGCTGTCCCTGCTGGCCCAGAATAAGCAGAGCAGC
AAGCTGGCCGCCAAGTGGCCTACAAAGCTGGTGAAGAACTGCTTCCTGCCA
CTGCGGGAGTACTTCAAGTATTTTTCCACCGAGCTGACATCATGCCTGGGA
GGACCCTCCTCTGGCGCCCCACCACCTAGCGGCGGCTCCCCTGCCGGCTCT
CCAACCAGCACAGAGGAGGGCACCAGCGAGTCCGCCACACCAGAGTCTGGA
CCTGGCACCAGCACAGAGCCATCCGAGGGCTCTGCCCCAGGCTCTCCTGCA
GGCAGCCCTACCTCCACCGAAGAGGGCACCAGCACAGAGCCTTCTGAGGGC
AGCGCCCCAGGCACCTCTACAGAGCCAAGCGAGCTCGAGGACAAGAAGTAC
AGCATCGGCCTGGCCATCGGCACCAACTCTGTGGGCTGGGCCGTGATCACC
GACGAGTACAAGGTGCCCAGCAAGAAATTCAAGGTGCTGGGCAACACCGAC
CGGCACAGCATCAAGAAGAACCTGATCGGAGCCCTGCTGTTCGACAGCGGC
GAAACAGCCGAGGCCACCCGGCTGAAGAGAACCGCCAGAAGAAGATACACC
AGACGGAAGAACCGGATCTGCTATCTGCAAGAGATCTTCAGCAACGAGATG
GCCAAGGTGGACGACAGCTTCTTCCACAGACTGGAAGAGTCCTTCCTGGTG
GAAGAGGATAAGAAGCACGAGCGGCACCCCATCTTCGGCAACATCGTGGAC
GAGGTGGCCTACCACGAGAAGTACCCCACCATCTACCACCTGAGAAAGAAA
CTGGTGGACAGCACCGACAAGGCCGACCTGCGGCTGATCTATCTGGCCCTG
GCCCACATGATCAAGTTCCGGGGCCACTTCCTGATCGAGGGCGACCTGAAC
CCCGACAACAGCGACGTGGACAAGCTGTTCATCCAGCTGGTGCAGACCTAC
AACCAGCTGTTCGAGGAAAACCCCATCAACGCCAGCGGCGTGGACGCCAAG
GCCATCCTGTCTGCCAGACTGAGCAAGAGCAGACGGCTGGAAAATCTGATC
GCCCAGCTGCCCGGCGAGAAGAAGAATGGCCTGTTCGGCAACCTGATTGCC
CTGAGCCTGGGCCTGACCCCCAACTTCAAGAGCAACTTCGACCTGGCCGAG
GATGCCAAACTGCAGCTGAGCAAGGACACCTACGACGACGACCTGGACAAC
CTGCTGGCCCAGATCGGCGACCAGTACGCCGACCTGTTTCTGGCCGCCAAG |

TABLE 7-continued sequences of exemplary epigenetic editors

| SEQ ID NO | Description | Sequence |
|---|---|---|
| | | AACCTGTCCGACGCCATCCTGCTGAGCGACATCCTGAGAGTGAACACCGAG<br>ATCACCAAGGCCCCCCTGAGCGCCTCTATGATCAAGAGATACGACGAGCAC<br>CACCAGGACCTGACCCTGCTGAAAGCTCTCGTGCGGCAGCAGCTGCCTGAG<br>AAGTACAAAGAGATTTTCTTCGACCAGAGCAAGAACGGCTACGCCGGCTAC<br>ATTGACGGCGGAGCCAGCCAGGAAGAGTTCTACAAGTTCATCAAGCCCATC<br>CTGGAAAAGATGGACGGCACCGAGGAACTGCTCGTGAAGCTGAACAGAGAG<br>GACCTGCTGCGGAAGCAGCGGACCTTCGACAACGGCAGCATCCCCCACCAG<br>ATCCACCTGGGAGAGCTGCACGCCATTCTGCGGCGGCAGGAAGATTTTTAC<br>CCATTCCTGAAGGACAACCGGGAAAAGATCGAGAAGATCCTGACCTTCCGC<br>ATCCCCTACTACGTGGGCCCTCTGGCCAGGGGAAACAGCAGATTCGCCTGG<br>ATGACCAGAAAGAGCGAGGAAACCATCACCCCCTGGAACTTCGAGGAAGTG<br>GTGGACAAGGGCGCTTCCGCCCAGAGCTTCATCGAGCGGATGACCAACTTC<br>GATAAGAACCTGCCCAACGAGAAGGTGCTGCCCAAGCACAGCCTGCTGTAC<br>GAGTACTTCACCGTGTATAACGAGCTGACCAAAGTGAAATACGTGACCGAG<br>GGAATGAGAAAGCCCGCCTTCCTGAGCGGCGAGCAGAAAAAGGCCATCGTG<br>GACCTGCTGTTCAAGACCAACCGGAAAGTGACCGTGAAGCAGCTGAAAGAG<br>GACTACTTCAAGAAAATCGAGTGCTTCGACTCCGTGGAAATCTCCGGCGTG<br>GAAGATCGGTTCAACGCCTCCCTGGGCACATACCACGATCTGCTGAAAATT<br>ATCAAGGACAAGGACTTCCTGGACAATGAGGAAAACGAGGACATTCTGGAA<br>GATATCGTGCTGACCCTGACACTGTTTGAGGACAGAGAGATGATCGAGGAA<br>CGGCTGAAAACCTATGCCCACCTGTTCGACGACAAAGTGATGAAGCAGCTG<br>AAGCGGCGGAGATACACCGGCTGGGGCAGGCTGAGCCGGAAGCTGATCAAC<br>GGCATCCGGGACAAGCAGTCCGGCAAGACAATCCTGGATTTCCTGAAGTCC<br>GACGGCTTCGCCAACAGAAACTTCATGCAGCTGATCCACGACGACAGCCTG<br>ACCTTTAAAGAGGACATCCAGAAAGCCCAGGTGTCCGGCCAGGGCGATAGC<br>CTGCACGAGCACATTGCCAATCTGGCCGGCAGCCCCGCCATTAAGAAGGGC<br>ATCCTGCAGACAGTGAAGGTGGTGGACGAGCTCGTGAAAGTGATGGGCCGG<br>CACAAGCCCGAGAACATCGTGATCGAAATGGCCAGAGAGAACCAGACCACC<br>CAGAAGGGACAGAAGAACAGCCGCGAGAGAATGAAGCGGATCGAAGAGGGC<br>ATCAAAGAGCTGGGCAGCCAGATCCTGAAAGAACACCCCGTGGAAAACACC<br>CAGCTGCAGAACGAGAAGCTGTACCTGTACTACCTGCAGAATGGGCGGGAT<br>ATGTACGTGGACCAGGAACTGGACATCAACCGGCTGTCCGACTACGATGTG<br>GACGCCATCGTGCCTCAGAGCTTTCTGAAGGACGACTCCATCGACAACAAG<br>GTGCTGACCAGAAGCGACAAGAACCGGGGCAAGAGCGACAACGTGCCCTCC<br>GAAGAGGTCGTGAAGAAGATGAAGAACTACTGGCGGCAGCTGCTGAACGCC<br>AAGCTGATTACCCAGAGAAAGTTCGACAATCTGACCAAGGCCGAGAGAGGC<br>GGCCTGAGCGAACTGGATAAGGCCGGCTTCATCAAGAGACAGCTGGTGGAA<br>ACCCGGCAGATCACAAAGCACGTGGCACAGATCCTGGACTCCCGGATGAAC<br>ACTAAGTACGACGAGAATGACAAGCTGATCCGGGAAGTGAAAGTGATCACC<br>CTGAAGTCCAAGCTGGTGTCCGATTTCCGGAAGGATTTCCAGTTTTACAAA<br>GTGCGCGAGATCAACAACTACCACCACGCCCACGACGCCTACCTGAACGCC<br>GTCGTGGGAACCGCCCTGATCAAAAAGTACCCTAAGCTGGAAAGCGAGTTC<br>GTGTACGGCGACTACAAGGTGTACGACGTGCGGAAGATGATCGCCAAGAGC<br>GAGCAGGAAATCGGCAAGGCTACCGCCAAGTACTTCTTCTACAGCAACATC<br>ATGAACTTTTTCAAGACCGAGATTACCCTGGCCAACGGCGAGATCCGGAAG<br>CGGCCTCTGATCGAGACAAACGGCGAAACCGGGGAGATCGTGTGGGATAAG<br>GGCCGGGATTTTGCCACCGTGCGGAAAGTGCTGAGCATGCCCCAAGTGAAT<br>ATCGTGAAAAAGACCGAGGTGCAGACAGGCGGCTTCAGCAAAGAGTCTATC<br>CTGCCCAAGAGGAACAGCGATAAGCTGATCGCCAGAAAGAAGGACTGGGAC<br>CCTAAGAAGTACGGCGGCTTCGACAGCCCCACCGTGGCCTATTCTGTGCTG<br>GTGGTGGCCAAAGTGGAAAAGGGCAAGTCCAAGAAACTGAAGAGTGTGAAA<br>GAGCTGCTGGGGATCACCATCATGGAAAGAAGCAGCTTCGAGAAGAATCCC<br>ATCGACTTTCTGGAAGCCAAGGGCTACAAAGAAGTGAAAAAGGACCTGATC<br>ATCAAGCTGCCTAAGTACTCCCTGTTCGAGCTGGAAAACGGCCGGAAGAGA<br>ATGCTGGCCTCTGCCGGCGAACTGCAGAAGGGAAACGAACTGGCCCTGCCC<br>TCCAAATATGTGAACTTCCTGTACCTGGCCAGCCACTATGAGAAGCTGAAG<br>GGCTCCCCCGAGGATAATGAGCAGAAACAGCTGTTTGTGGAACAGCACAAG<br>CACTACCTGGACGAGATCATCGAGCAGATCAGCGAGTTCTCCAAGAGAGTG<br>ATCCTGGCCGACGCTAATCTGGACAAAGTGCTGTCCGCCTACAACAAGCAC<br>CGGGATAAGCCCATCAGAGAGCAGGCCGAGAATATCATCCACCTGTTTACC<br>CTGACCAATCTGGGAGCCCCTGCCGCCTTCAAGTACTTTGACACCACCATC<br>GACCGGAAGAGGTACACCAGCACCAAAGAGGTGCTGGACGCCACCCTGATC<br>CACCAGAGCATCACCGGCCTGTACGAGACACGGATCGACCTGTCTCAGCTG<br>GGAGGCGACAGCCCAAGAAGAAGAGAAAGGTGGGAGTCGACGGATCCAGC<br>GGCTCCGAGACCCCAGGCACATCTGAGAGCGCCACCCCTGAGTCCACCGGT<br>ATGAACAATTCACAGGGAGAGTGACATTCGAAGACGTGACCGTGAACTTC<br>ACCCAGGGAGAATGGCAGCGCTTGAACCCAGAACAAAGGAACCTCTATCGG<br>GACGTGATGCTGGAAAACTACTCAAATTTGGTGAGCGTTGGGCAGGGTGAG<br>ACCACTAAGCCTGACGTGATCCTGAGATTGGAACAGGGCAAGGAGCCTTGG<br>CTCGAGGAAGAGGAAGTCCTGGGCTCAGGGAGGGCCGAGAAAAACGGTGAT<br>ATAGGAGGCCAGATATGGAAGCCTAAGGACGTCAAGGAGAGCCTGAGCGCT<br>GATTACAAAGATGATGACGATAAGCCCCCAAGAAGAAAAGGAAGGTCCCA<br>AAGAAAAAAAGAAAGGTGTGA |

TABLE 7-continued sequences of exemplary epigenetic editors

| SEQ ID NO | Description | Sequence |
|---|---|---|
| 492 | PLA003 amino acid sequence | MPKKKRKVPKKKRKVYNHDQEFDPPKVYPPVPAEKRKPIRVLSLEDGIATG LLVLKDLGIQVDRYIASEVCEDSITVGMVRHQGKIMYVGDVRSVTQKHIQE WGPFDLVIGGSPCNDLSIVNPARKGLYEGTGRLFFEFYRLLHDARPKEGDD RPFFWLFENVVAMGVSDKRDISRFLESNPVMIDAKEVSAAHRARYFWGNLP GMNRPLASTVNDKLELQECLEHGRIAKFSKVRTITTRSNSIKQGKDQHFPV FMNEKEDILWCTEMERVFGFPVHYTDVSNMSRLARQRLLGRSWSVPVIRHL FAPLKEYFACVSSGNSNANSRGPSFSSGLVPLSLRGSHMAAIPALDPEAEP SMDVILVGSSELSSSVSPGTGRDLIAYEVKANQRNIEDICICCGSLQVHTQ HPLFEGGICAPCKDKFLDALFLYDDDGYQSYCSICCSGETLLICGNPDCTR CYCFECVDSLVGPGTSGKVHAMSNWVCYLCLPSSRSGLLQRRRKWRSQLKA FYDRESENPLEMFETVPVWRRQPVRVLSLFEDIKKELTSLGFLESGSDPGQ LKHVVDVTDTVRKDVEEWGPFDLVYGATPPLGHTCDRPPSWYLFQFHRLLQ YARPKPGSPRPFFWMFVDNLVLNKEDLDVASRFLEMEPVTIPDVHGGSLQN AVRVWSNIPAIRSRHWALVSEEELSLLAQNKQSSKLAAKWPTKLVKNCFLP LREYFKYFSTELTSSLGGPSSGAPPPSGGSPAGSPTSTEEGTSESATPESG PGTSTEPSEGSAPGSPAGSPTSTEEGTSTEPSEGSAPGTSTEPSELEDKKY SIGLAIGTNSVGWAVITDEYKVPSKKFKVLGNTDRHSIKKNLIGALLEDSG ETAEATRLKRTARRRYTRRKNRICYLQEIFSNEMAKVDDSFFHRLEESFLV EEDKKHERHPIFGNIVDEVAYHEKYPTIYHLRKKLVDSTDKADLRLIYLAL AHMIKFRGHFLIEGDLNPDNSDVDKLFIQLVQTYNQLFEENPINASGVDAK AILSARLSKSRRLENLIAQLPGEKKNGLFGNLIALSLGLTPNFKSNEDLAE DAKLQLSKDTYDDDLDNLLAQIGDQYADLFLAAKNLSDAILLSDILRVNTE ITKAPLSASMIKRYDEHHQDLTLLKALVRQQLPEKYKEIFFDQSKNGYAGY IDGGASQEEFYKFIKPILEKMDGTEELLVKLNREDLLRKQRTEDNGSIPHQ IHLGELHAILRRQEDFYPFLKDNREKIEKILTFRIPYYVGPLARGNSRFAW MTRKSEETITPWNFEEVVDKGASAQSFIERMTNEDKNLPNEKVLPKHSLLY EYFTVYNELTKVKYVTEGMRKPAFLSGEQKKAIVDLLFKTNRKVTVKQLKE DYFKKIECFDSVEISGVEDRENASLGTYHDLLKIIKDKDELDNEENEDILE DIVLTLTLFEDREMIEERLKTYAHLEDDKVMKQLKRRRYTGWGRLSRKLIN GIRDKQSGKTILDFLKSDGFANRNFMQLIHDDSLTFKEDIQKAQVSGQGDS LHEHIANLAGSPAIKKGILQTVKVVDELVKVMGRHKPENIVIEMARENQTT QKGQKNSRERMKRIEEGIKELGSQILKEHPVENTQLQNEKLYLYYLQNGRD MYVDQELDINRLSDYDVDAIVPQSFLKDDSIDNKVLTRSDKNRGKSDNVPS EEVVKKMKNYWRQLLNAKLITQRKEDNLTKAERGGLSELDKAGFIKRQLVE TRQITKHVAQILDSRMNTKYDENDKLIREVKVITLKSKLVSDERKDFQFYK VREINNYHHAHDAYLNAVVGTALIKKYPKLESEFVYGDYKVYDVRKMIAKS EQEIGKATAKYFFYSNIMNFFKTEITLANGEIRKRPLIETNGETGEIVWDK GRDFATVRKVLSMPQVNIVKKTEVQTGGFSKESILPKRNSDKLIARKKDWD PKKYGGFDSPTVAYSVLVVAKVEKGKSKKLKSVKELLGITIMERSSFEKNP IDFLEAKGYKEVKKDLIIKLPKYSLFELENGRKRMLASAGELQKGNELALP SKYVNFLYLASHYEKLKGSPEDNEQKQLFVEQHKHYLDEIIEQISEFSKRV ILADANLDKVLSAYNKHRDKPIREQAENIIHLFTLTNLGAPAAFKYEDTTI DRKRYTSTKEVLDATLIHQSITGLYETRIDLSQLGGDSPKKKRKVGVDGSS GSETPGTSESATPESTGMNNSQGRVTFEDVTVNETQGEWQRLNPEQRNLYR DVMLENYSNLVSVGQGETTKPDVILRLEQGKEPWLEEEEVLGSGRAEKNGD IGGQIWKPKDVKESLSAPKKKRKVPKKKRKV |
| 493 | PLA003 full plasmid sequence | GGGCGCTCGAGCAGGTTCAGAAGGAGATCAAAAACCCCCAAGGATCAAACA TGCCAAAAAAGAAGAGAAAGGTACCGAAGAAAAAAAGAAAGGTATACAATC ACGATCAGGAGTTCGACCCCCCTAAGGTGTACCCACCAGTGCCTGCAGAGA AGAGGAAGCCAATCCGGGTGCTGAGCCTGTTTGATGGCATCGCCACCGGCC TGCTGGTGCTGAAGGATCTGGGCATCCAGGTGGACCGGTACATCGCCTCCG AGGTGTGCGAGGATTCTATCACCGTGGGCATGGTGCGCCACCAGGGCAAGA TCATGTATGTGGGCGACGTGCGGTCCGTGACACAGAAGCACATCCAGGAGT GGGGCCCATTCGATCTGGTGATCGGCGGCAGCCCTGTAATGACCTGTCCA TCGTGAACCCTGCAAGGAAGGGACTGTACGAGGGAACCGGCCGGCTGTTCT TTGAGTTTTATAGACTGCTGCACGACGCCAGGCCTAAGGAGGGCGACGATA GACCATTCTTTTGGCTGTTCGAGAATGTGGTGGCTATGGGCGTGAGCGATA AGAGGGACATCTCCAGGTTTCTGGAGTCTAACCCCGTGATGATCGATGCAA AGGAGGTGTCCGCCGCACACAGAGCCAGGTATTTCTGGGGCAATCTGCCAG GAATGAACAGGCCACTGGCAAGCACCGTGAATGACAAGCTGGAGCTGCAGG AGTGCCTGGAGCACGGAAGGATCGCCAAGTTTTCCAAGGTGCGCACAATCA CCACACGGAGCAATTCCATCAAGCAGGGCAAGGATCAGCACTTCCCCGTGT TCATGAACGAGAAGGAGGACATCCTGTGGTGTACCGAGATGGAGAGAGTGT TCGGCTTTCCAGTGCACTACACAGACGTGTCTAACATGAGCAGGCTGGCAA GGCAGCGGCTGCTGGGCAGATCTTGGAGCGTGCCCGTGATCAGGCACCTGT TCGCCCCTCTGAAGGAGTATTTTGCCTGCGTGAGCAGCGGCAACTCCAATG CCAACAGCCGGGGCCCCTCTTTCAGCTCCGGATTGGTGCCTCTGAGCCTGA GGGGCTCCCACATGGCAGCAATCCCCGCCCTGGACCCCGAGGCCGAGCCTA GCATGGACGTGATCCTGGTGGGCTCTAGCGAGCTGTCCTCTAGCGTGTCTC CAGGAACCGGAAGGGATCTGATCGCATACGAGGTGAAGGCCAATCAGCGGA ACATCGAGGACATCTGTATCTGCTGTGGCAGCCTGCAGGTGCACACACAGC ACCCCACTGTTCGAGGGAGGAATCTGCGCACCCTGTAAGGATAAGTTCCTGG ACGCCCTGTTTCTGTACGACGATGACGGCTACCAGTCCTATTGCTCTATCT |

TABLE 7-continued sequences of exemplary epigenetic editors

| SEQ ID NO | Description | Sequence |
|---|---|---|
| | | GCTGTTCCGGCGAGACCCTGCTGATCTGCGGCAATCCAGATTGTACAAGGT
GCTATTGTTTTGAGTGCGTGGACTCTCTGGTGGGACCAGGCACCAGCGGAA
AGGTGCACGCCATGTCCAACTGGGTGTGCTACCTGTGCCTGCCATCCTCTC
GCAGCGGACTGCTGCAGCGGAGAAGGAAGTGGAGATCCCAGCTGAAGGCCT
TCTATGATAGGGAGTCTGAGAACCCCCTGGAGATGTTTGAGACCGTGCCAG
TGTGGCGCCGGCAGCCCGTGAGGGTGCTGAGCCTGTTCGAGGATATCAAGA
AGGAGCTGACATCCCTGGGCTTTCTGGAGTCCGGCTCTGACCCCGGACAGC
TGAAGCACGTGGTGGATGTGACCGACACAGTGCGGAAGGATGTGGAGGAGT
GGGGCCCTTTCGACCTGGTGTACGGAGCAACCCCTCCACTGGGACACACAT
GCGACAGACCCCCTTCTTGGTACCTGTTCCAGTTTCACCGCCTGCTGCAGT
ATGCAAGGCCAAAGCCAGGCAGCCCTAGACCATTCTTTTGGATGTTCGTGG
ATAATCTGGTGCTGAACAAGGAGGATCTGGACGTGGCCAGCAGGTTTCTGG
AGATGGAGCCAGTGACCATCCCAGACGTGCACGGCGGCTCCCTGCAGAATG
CCGTGCGCGTGTGGTCTAACATCCCTGCCATCAGAAGCAGGCACTGGGCAC
TGGTGAGCGAGGAGGAGCTGTCCCTGCTGGCCCAGAATAAGCAGAGCAGCA
AGCTGGCCGCCAAGTGGCCTACAAAGCTGGTGAAGAACTGCTTCCTGCCAC
TGCGGGAGTACTTCAAGTATTTTTCCACCGAGCTGACATCTAGCCTGGGAG
GACCCTCCTCTGGCGCCCCACCACCTAGCGGCGGCTCCCCTGCCGGCTCTC
CAACCAGCACAGAGGAGGGCACCAGCGAGTCCGCCACACCAGAGTCTGGAC
CTGGCACCAGCACAGAGCCATCCGAGGGCTCTGCCCCAGGCTCTCCTGCAG
GCAGCCCTACCTCCACCGAAGAGGGCACCAGCACAGAGCCTTCTGAGGGCA
GCGCCCCAGGCACCTCTACAGAGCCAAGCGAGCTCGAGGACAAGAAGTACA
GCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACC
GGCACAGCATCAAGAAGAACCTGATCGGAGCCCTGCTGTTCGACAGCGGCG
AAACAGCCGAGGCCACCCGGCTGAAGAGAACCGCCAGAAGAAGATACACCA
GACGGAAGAACCGGATCTGCTATCTGCAAGAGATCTTCAGCAACGAGATGG
CCAAGGTGGACGACAGCTTCTTCCACAGACTGGAAGAGTCCTTCCTGGTGG
AAGAGGATAAGAAGCACGAGCGGCACCCCATCTTCGGCAACATCGTGGACG
AGGTGGCCTACCACGAGAAGTACCCCACCATCTACCACCTGAGAAAGAAAC
TGGTGGACAGCACCGACAAGGCCGACCTGCGGCTGATCTATCTGGCCCTGG
CCCACATGATCAAGTTCCGGGGCCACTTCCTGATCGAGGGCGACCTGAACC
CCGACAACAGCGACGTGGACAAGCTGTTCATCCAGCTGGTGCAGACCTACA
ACCAGCTGTTCGAGGAAAACCCCATCAACGCCAGCGGCGTGGACGCCAAGG
CCATCCTGTCTGCCAGACTGAGCAAGAGCAGACGGCTGGAAAATCTGATCG
CCCAGCTGCCCGGCGAGAAGAAGAATGGCCTGTTCGGCAACCTGATTGCCC
TGAGCCTGGGCCTGACCCCCAACTTCAAGAGCAACTTCGACCTGGCCGAGG
ATGCCAAACTGCAGCTGAGCAAGGACACCTACGACGACGACCTGGACAACC
TGCTGGCCCAGATCGGCGACCAGTACGCCGACCTGTTTCTGGCCGCCAAGA
ACCTGTCCGACGCCATCCTGCTGAGCGACATCCTGAGAGTGAACACCGAGA
TCACCAAGGCCCCCCTGAGCGCCTCTATGATCAAGAGATACGACGAGCACC
ACCAGGACCTGACCCTGCTGAAAGCTCTCGTGCGGCAGCAGCTGCCTGAGA
AGTACAAAGAGATTTTCTTCGACCAGAGCAAGAACGGCTACGCCGGCTACA
TTGACGGCGGAGCCAGCCAGGAAGAGTTCTACAAGTTCATCAAGCCCATCC
TGGAAAAGATGGACGGCACCGAGGAACTGCTCGTGAAGCTGAACAGAGAGG
ACCTGCTGCGGAAGCAGCGGACCTTCGACAACGGCAGCATCCCCCACCAGA
TCCACCTGGGAGAGCTGCACGCCATTCTGCGGCGGCAGGAAGATTTTTACC
CATTCCTGAAGGACAACCGGGAAAAGATCGAGAAGATCCTGACCTTCCGCA
TCCCCTACTACGTGGGCCCTCTGGCCAGGGGAAACAGCAGATTCGCCTGGA
TGACCAGAAAGAGCGAGGAAACCATCACCCCCTGGAACTTCGAGGAAGTGG
TGGACAAGGGCGCTTCCGCCCAGAGCTTCATCGAGCGGATGACCAACTTCG
ATAAGAACCTGCCCAACGAGAAGGTGCTGCCCAAGCACAGCCTGCTGTACG
AGTACTTCACCGTGTATAACGAGCTGACCAAAGTGAAATACGTGACCGAGG
GAATGAGAAAGCCCGCCTTCCTGAGCGGCGAGCAGAAAAAGGCCATCGTGG
ACCTGCTGTTCAAGACCAACCGGAAAGTGACCGTGAAGCAGCTGAAAGAGG
ACTACTTCAAGAAAATCGAGTGCTTCGACTCCGTGGAAATCTCCGGCGTGG
AAGATCGGTTCAACGCCTCCCTGGGCACATACCACGATCTGCTGAAAATTA
TCAAGGACAAGGACTTCCTGGACAATGAGGAAAACGAGGACATTCTGGAAG
ATATCGTGCTGACCCTGACACTGTTTGAGGACAGAGAGATGATCGAGGAAC
GGCTGAAAACCTATGCCCACCTGTTCGACGACAAAGTGATGAAGCAGCTGA
AGCGGCGGAGATACACCGGCTGGGGCAGGCTGAGCCGGAAGCTGATCAACG
GCATCCGGGACAAGCAGTCCGGCAAGACAATCCTGGATTTCCTGAAGTCCG
ACGGCTTCGCCAACAGAAACTTCATGCAGCTGATCCACGACGACAGCCTGA
CCTTTAAAGAGGACATCCAGAAAGCCCAGGTGTCCGGCCAGGGCGATAGCC
TGCACGAGCACATTGCCAATCTGGCCGGCAGCCCCGCCATTAAGAAGGGCA
TCCTGCAGACAGTGAAGGTGGTGGACGAGCTCGTGAAAGTGATGGGCCGGC
ACAAGCCCGAGAACATCGTGATCGAAATGGCCAGAGAGAACCAGACCACCC
AGAAGGGACAGAAGAACAGCCGCGAGAGAATGAAGCGGATCGAAGAGGGCA
TCAAAGAGCTGGGCAGCCAGATCCTGAAAGAACACCCCGTGGAAAACACCC
AGCTGCAGAACGAGAAGCTGTACCTGTACTACCTGCAGAATGGGCGGGATA
TGTACGTGGACCAGGAACTGGACATCAACCGGCTGTCCGACTACGATGTGG
ACGCCATCGTGCCTCAGAGCTTTCTGAAGGACGACTCCATCGACAACAAGG
TGCTGACCAGAAGCGACAAGAACCGGGGCAAGAGCGACAACGTGCCCTCCG
AAGAGGTCGTGAAGAAGATGAAGAACTACTGGCGGCAGCTGCTGAACGCCA
AGCTGATTACCCAGAGAAAGTTCGACAATCTGACCAAGGCCGAGAGAGGCG |

TABLE 7-continued sequences of exemplary epigenetic editors

| SEQ ID NO | Description | Sequence |
|---|---|---|
| | | GCCTGAGCGAACTGGATAAGGCCGGCTTCATCAAGAGACAGCTGGTGGAAA
CCCGGCAGATCACAAAGCACGTGGCACAGATCCTGGACTCCCGGATGAACA
CTAAGTACGACGAGAATGACAAGCTGATCCGGGAAGTGAAAGTGATCACCC
TGAAGTCCAAGCTGGTGTCCGATTTCCGGAAGGATTTCCAGTTTTACAAAG
TGCGCGAGATCAACAACTACCACCACGCCCACGACGCCTACCTGAACGCCG
TCGTGGGAACCGCCCTGATCAAAAAGTACCCTAAGCTGGAAAGCGAGTTCG
TGTACGGCGACTACAAGGTGTACGACGTGCGGAAGATGATCGCCAAGAGCG
AGCAGGAAATCGGCAAGGCTACCGCCAAGTACTTCTTCTACAGCAACATCA
TGAACTTTTTCAAGACCGAGATTACCCTGGCCAACGGCGAGATCCGGAAGC
GGCCTCTGATCGAGACAAACGGCGAAACCGGGGAGATCGTGTGGGATAAGG
GCCGGGATTTTGCCACCGTGCGGAAAGTGCTGAGCATGCCCCAAGTGAATA
TCGTGAAAAAGACCGAGGTGCAGACAGGCGGCTTCAGCAAAGAGTCTATCC
TGCCCAAGAGGAACAGCGATAAGCTGATCGCCAGAAAGAAGGACTGGGACC
CTAAGAAGTACGGCGGCTTCGACAGCCCCACCGTGGCCTATTCTGTGCTGG
TGGTGGCCAAAGTGGAAAAGGGCAAGTCCAAGAAACTGAAGAGTGTGAAAG
AGCTGCTGGGGATCACCATCATGGAAAGAAGCAGCTTCGAGAAGAATCCCA
TCGACTTTCTGGAAGCCAAGGGCTACAAAGAAGTGAAAAAGGACCTGATCA
TCAAGCTGCCTAAGTACTCCCTGTTCGAGCTGGAAAACGGCCGGAAGAGAA
TGCTGGCCTCTGCCGGCGAACTGCAGAAGGGAAACGAACTGGCCCTGCCCT
CCAAATATGTGAACTTCCTGTACCTGGCCAGCCACTATGAGAAGCTGAAGG
GCTCCCCCGAGGATAATGAGCAGAAACAGCTGTTTGTGGAACAGCACAAGC
ACTACCTGGACGAGATCATCGAGCAGATCAGCGAGTTCTCCAAGAGAGTGA
TCCTGGCCGACGCTAATCTGGACAAAGTGCTGTCCGCCTACAACAAGCACC
GGGATAAGCCCATCAGAGAGCAGGCCGAGAATATCATCCACCTGTTTACCC
TGACCAATCTGGGAGCCCCTGCCGCCTTCAAGTACTTTGACACCACCATCG
ACCGGAAGAGGTACACCAGCACCAAAGAGGTGCTGGACGCCACCCTGATCC
ACCAGAGCATCACCGGCCTGTACGAGACACGGATCGACCTGTCTCAGCTGG
GAGGCGACAGCCCCAAGAAGAAGAAAGGTGGGAGTCGACGGATCCAGCG
GCTCCGAGACCCCAGGCACATCTGAGAGCGCCACCCCTGAGTCCACCGGTA
TGAACAATTCACAGGGGAGAGTGACATTCGAAGACGTGACCGTGAACTTCA
CCCAGGGAGAATGGCAGCGCTTGAACCCAGAACAAAGGAACCTCTATCGGG
ACGTGATGCTGGAAAACTACTCAAATTTGGTGAGCGTTGGGCAGGGTGAGA
CCACTAAGCCTGACGTGATCCTGAGATTGGAACAGGGCAAGGAGCCTTGGC
TCGAGGAAGAGGAAGTCCTGGGCTCAGGGAGGGCCGAGAAAAACGGTGATA
TAGGAGGCCAGATATGGAAGCCTAAGGACGTCAAGGAGAGCCTGAGCGCTC
CCAAGAAGAAAGGAAGGTCCCAAAGAAAAAAAGAAAGGTGTGAGGATCCT
GAGTCTAGAAATCAACCTCTGGATTACAAAATTTGTGAAAGATTGACTGGT
ATTCTTAACTATGTTGCTCCTTTTACGCTATGTGGATACGCTGCTTTAATG
CCTTTGTATCATGCTATTGCTTCCCGTATGGCTTTCATTTTCTCCTCCTTG
TATAAATCCTGGTTGCTGTCTCTTTATGAGGAGTTGTGGCCCGTTGTCAGG
CAACGTGGCGTGGTGTGCACTGTGTTTGCTGACGCAACCCCCACTGGTTGG
GGCATTGCCACCACCTGTCAGCTCCTTTCCGGGACTTTCGCTTTCCCCCTC
CCTATTGCCACGGCGGAACTCATCGCCGCCTGCCTTGCCCGCTGCTGGACA
GGGGCTCGGCTGTTGGGCACTGACAATTCCGTGGTGTTGTCGGGGAAATCA
TCGTCCTTTCCTTGGCTGCTCGCCTGTGTTGCCACCTGGATTCTGCGCGGG
ACGTCCTTCTGCTACGTCCCTTCGGCCCTCAATCCAGCGGACCTTCCTTCC
CGCGGCCTGCTGCCGGCTCTGCGGCCTCTTCCGCGTCTTCGCCTTCGCCCT
CAGACGAGTCGGATCTCCCTTTGGGCCGCCTCCCCGCCTGTTAATTAAAAA
AAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAGCTTGA
AGAGCCTAGTGGCGCCTGATGCGGTATTTTCTCCTTACGCATCTGTGCGGT
ATTTCACACCGCATAATCCAGCACAGTGGCGGCCCGTTTAAACCCGCTGAT
CAGCCTCGACTGTGCCTTCTAGTTGCCAGCCATCTGTTGTTTGCCCCTCCC
CCGTGCCTTCCTTGACCCTGGAAGGTGCCACTCCCACTGTCCTTTCCTAAT
AAAATGAGGAAATTGCATCGCATTGTCTGAGTAGGTGTCATTCTATTCTGG
GGGGTGGGGTGGGGCAGGACAGCAAGGGGGAGGATTGGGAAGACAATAGCA
GGCATGCTGGGGATGCGGTGGGCTCTATGGCTTCTGAGGCGGAAAGAACCA
GCTGCATTAATGAATCGGCCAACGCGCGGGGAGAGGCGGTTTGCGTATTGG
GCGCTCTTCCGCTTCCTCGCTCACTGACTCGCTGCGCTCGGTCGTTCGGCT
GCGGCGAGCGGTATCAGCTCACTCAAAGGCGGTAATACGGTTATCCACAGA
ATCAGGGGATAACGCAGGAAAGAACATGTGAGCAAAAGGCCAGCAAAGGC
CAGGAACCGTAAAAAGGCCGCGTTGCTGGCGTTTTTCCATAGGCTCCGCCC
CCCTGACGAGCATCACAAAAATCGACGCTCAAGTCAGAGGTGGCGAAACCC
GACAGGACTATAAAGATACCAGGCGTTTCCCCCTGGAAGCTCCCTCGTGCG
CTCTCCTGTTCCGACCCTGCCGCTTACCGGATACCTGTCCGCCTTTCTCCC
TTCGGGAAGCGTGGCGCTTTCTCATAGCTCACGCTGTAGGTATCTCAGTTC
GGTGTAGGTCGTTCGCTCCAAGCTGGGCTGTGTGCACGAACCCCCCGTTCA
GCCCGACCGCTGCGCCTTATCCGGTAACTATCGTCTTGAGTCCAACCCGGT
AAGACACGACTTATCGCCACTGGCAGCAGCCACTGGTAACAGGATTAGCAG
AGCGAGGTATGTAGGCGGTGCTACAGAGTTCTTGAAGTGGTGGCCTAACTA
CGGCTACACTAGAAGAACAGTATTTGGTATCTGCGCTCTGCTGAAGCCAGT
TACCTTCGGAAAAAGAGTTGGTAGCTCTTGATCCGGCAAACAAACCACCGC
TGGTAGCGGTGGTTTTTTTGTTTGCAAGCAGCAGATTACGCGCAGAAAAAA
AGGATCTCAAGAAGATCCTTTGATCTTTTCTACGGGGTCTGACGCTCAGTG
GAACGAAAACTCACGTTAAGGGATTTTGGTCATGAGATTATCAAAAAGGAT |

TABLE 7-continued sequences of exemplary epigenetic editors

| SEQ ID NO | Description | Sequence |
|---|---|---|
| | | CTTCACCTAGATCCTTTTAAATTAAAAATGAAGTTTTAAATCAATCTAAAG<br>TATATATGAGTAAACTTGGTCTGACAGTTAGAAAAACTCATCGAGCATCAA<br>ATGAAACTGCAATTTATTCATATCAGGATTATCAATACCATATTTTTGAAA<br>AAGCCGTTTCTGTAATGAAGGAGAAAACTCACCGAGGCAGTTCCATAGGAT<br>GGCAAGATCCTGGTATCGGTCTGCGATTCCGACTCGTCCAACATCAATACA<br>ACCTATTAATTTCCCCTCGTCAAAAATAAGGTTATCAAGTGAGAAATCACC<br>ATGAGTGACGACTGAATCCGGTGAGAATGGCAAAAGTTTATGCATTTCTTT<br>CCAGACTTGTTCAACAGGCCAGCCATTACGCTCGTCATCAAAATCACTCGC<br>ATCAACCAAACCGTTATTCATTCGTGATTGCGCCTGAGCGAAACGAAATAC<br>GCGATCGCTGTTAAAGGACAATTACAAACAGGAATCGAATGCAACCGGCG<br>CAGGAACACTGCCAGCGCATCAACAATATTTTCACCTGAATCAGGATATTC<br>TTCTAATACCTGGAATGCTGTTTTCCCAGGGATCGCAGTGGTGAGTAACCA<br>TGCATCATCAGGAGTACGGATAAAATGCTTGATGGTCGGAAGAGGCATAAA<br>TTCCGTCAGCCAGTTTAGTCTGACCATCTCATCTGTAACATCATTGGCAAC<br>GCTACCTTTGCCATGTTTCAGAAACAACTCTGGCGCATCGGGCTTCCCATA<br>CAATCGATAGATTGTCGCACCTGATTGCCCGACATTATCGCGAGCCCATTT<br>ATACCCATATAAATCAGCATCCATGTTGGAATTTAATCGCGGCCTAGAGCA<br>AGACGTTTCCCGTTGAATATGGCTCATACTCTTCCTTTTTCAATATTATTG<br>AAGCATTTATCAGGGTTATTGTCTCATGAGCGGATACATATTTGAATGTAT<br>TTAGAAAAATAAACAAATAGGGGTTCCGCGCACATTTCCCCGAAAAGTACC<br>ACCTGACGTCGATCGACGGATCGGGAGATCTCCCGATCCCCTATGGTGCAC<br>TCTCAGTACAATCTGCTCTGATGCCGCATAGTTAAGCCAGTATCTGCTCCC<br>TGCTTGTGTGTTGGAGGTCGCTGAGTAGTGCGCGAGCAAAATTTAAGCTAC<br>AACAAGGCAAGGCTTGACCGACAATTGCATGAAGAATCTGCTTAGGGTTAG<br>GCGTTTTGCGCTGCTTCGCGATGTACGGGCCAGATATACGCGTTGACATTG<br>ATTATTGACTAGTTATTAATAGTAATCAATTACGGGGTCATTAGTTCATAG<br>CCCATATATGGAGTTCCGCGTTACATAACTTACGGTAAATGGCCCGCCTGG<br>CTGACCGCCCAACGACCCCCGCCCATTGACGTCAATAATGACGTATGTTCC<br>CATAGTAACGCCAATAGGGACTTTCCATTGACGTCAATGGGTGGAGTATTT<br>ACGGTAAACTGCCCACTTGGCAGTACATCAAGTGTATCATATGCCAAGTAC<br>GCCCCCTATTGACGTCAATGACGGTAAATGGCCCGCCTGGCATTATGCCCA<br>GTACATGACCTTATGGGACTTTCCTACTTGGCAGTACATCTACGTATTAGT<br>CATCGCTATTACCATGGTGATGCGGTTTTGGCAGTACATCAATGGGCGTGG<br>ATAGCGGTTTGACTCACGGGGATTTCCAAGTCTCCACCCCATTGACGTCAA<br>TGGGAGTTTGTTTTGGCACCAAAATCAACGGGACTTTCCAAAATGTCGTAA<br>CAACTCCGCCCCATTGACGCAAATGGGCGGTAGGCGTGTACGGTGGGAGGT<br>CTATATAAGCAGAGCTCTCTGGCTAACTAGAGAACCCACTGCTTACTGGCT<br>TATCGAAATTAATACGACTCACTATAAG |
| 494 | PLA003 plasmid coding sequence | ATGCCAAAAAAGAAGAGAAAGGTACCGAAGAAAAAAAGAAAGGTATACAAT<br>CACGATCAGGAGTTCGACCCCCCTAAGGTGTACCCACCAGTGCCTGCAGAG<br>AAGAGGAAGCCAATCCGGGTGCTGAGCCTGTTTGATGGCATCGCCACCGGC<br>CTGCTGGTGCTGAAGGATCTGGGCATCCAGGTGGACCGGTACATCGCCTCC<br>GAGGTGTGCGAGGATTCTATCACCGTGGGCATGGTGCGCCACCAGGGCAAG<br>ATCATGTATGTGGGCGACGTGCGGTCCGTGACACAGAAGCACATCCAGGAG<br>TGGGGCCCATTCGATCTGGTGATCGGCGGCAGCCCCTGTAATGACCTGTCC<br>ATCGTGAACCCTGCAAGGAAGGGACTGTACGAGGGAACCGGCCGGCTGTTC<br>TTTGAGTTTTATAGACTGCTGCACGACGCCAGGCCTAAGGAGGGCGACGAT<br>AGACCATTCTTTTGGCTGTTCGAGAATGTGGTGGCTATGGGCGTGAGCGAT<br>AAGAGGGACATCTCCAGGTTTCTGGAGTCTAACCCCGTGATGATCGATGCA<br>AAGGAGGTGTCCGCCGCACACAGAGCCAGGTATTTCTGGGGCAATCTGCCA<br>GGAATGAACAGGCCACTGGCAAGCACCGTGAATGACAAGCTGGAGCTGCAG<br>GAGTGCCTGGAGCACGGAAGGATCGCCAAGTTTTCCAAGGTGCGCACAATC<br>ACCACACGGAGCAATTCCATCAAGCAGGGCAAGGATCAGCACTTCCCCGTG<br>TTCATGAACGAGAAGGAGGACATCCTGTGGTGTACCGAGATGGAGAGAGTG<br>TTCGGCTTTCCAGTGCACTACACAGACGTGTCTAACATGAGCAGGCTGGCA<br>AGGCAGCGGCTGCTGGGCAGATCTTGGAGCGTGCCCGTGATCAGGCACCTG<br>TTCGCCCCTCTGAAGGAGTATTTTGCCTGCGTGAGCAGCGGCAACTCCAAT<br>GCCAACAGCCGGGGCCCCTCTTTCAGCTCCGGATTGGTGCCTCTGAGCCTG<br>AGGGGCTCCCACATGGCAGCAATCCCCGCCCTGGACCCCGAGGCCGAGCCT<br>AGCATGGACGTGATCCTGGTGGGCTCTAGCGAGCTGTCCTCTAGCGTGTCT<br>CCAGGAACCGGAAGGGATCTGATCGCATACGAGGTGAAGGCCAATCAGCGG<br>AACATCGAGGACATCTGTATCTGCTGTGGCAGCCTGCAGGTGCACACACAG<br>CACCCACTGTTCGAGGGAGGAATCTGCGCACCCTGTAAGGATAAGTTCCTG<br>GACGCCCTGTTTCTGTACGACGATGACGGCTACCAGTCCTATTGCTCTATC<br>TGCTGTTCCGGCGAGACCCTGCTGATCTGCGGCAATCCAGATTGTACAAGG<br>TGCTATTGTTTGAGTGCGTGGACTCTCTGGTGGGACCAGGCACCAGCGGA<br>AAGGTGCACGCCATGTCCAACTGGGTGTGCTACCTGTGCCTGCCATCCTCT<br>CGCAGCGGACTGCTGCAGCGGAGAAGGAAGTGGAGATCCCAGCTGAAGGCC<br>TTCTATGATAGGGAGTCTGAGAACCCCCTGGAGATGTTTGAGACCGTGCCA<br>GTGTGGCGCCGGCAGCCCGTGAGGGTGCTGAGCCTGTTCGAGGATATCAAG<br>AAGGAGCTGACATCCCTGGGCTTTCTGGAGTCCGGCTCTGACCCCGACAG<br>CTGAAGCACGTGGTGGATGTGACCGACACAGTGCGGAAGGATGTGGAGGAG<br>TGGGGCCCTTTCGACCTGGTGTACGGAGCAACCCCTCCACTGGGACACACA<br>TGCGACAGACCCCCTTCTTGGTACCTGTTCCAGTTTCACCGCCTGCTGCAG |

TABLE 7-continued sequences of exemplary epigenetic editors

| SEQ ID NO | Description | Sequence |
|---|---|---|
| | | TATGCAAGGCCAAAGCCAGGCAGCCCTAGACCATTCTTTTGGATGTTCGTG
GATAATCTGGTGCTGAACAAGGAGGATCTGGACGTGGCCAGCAGGTTTCTG
GAGATGGAGCCAGTGACCATCCCAGACGTGCACGGCGGCTCCCTGCAGAAT
GCCGTGCGCGTGTGGTCTAACATCCCTGCCATCAGAAGCAGGCACTGGGCA
CTGGTGAGCGAGGAGGAGCTGTCCCTGCTGGCCCAGAATAAGCAGAGCAGC
AAGCTGGCCGCCAAGTGGCCTACAAAGCTGGTGAAGAACTGCTTCCTGCCA
CTGCGGGAGTACTTCAAGTATTTTTCCACCGAGCTGACATCTAGCCTGGGA
GGACCCTCCTCTGGCGCCCCACCACCTAGCGGCGGCTCCCCTGCCGGCTCT
CCAACCAGCACAGAGGAGGGCACCAGCGAGTCCGCCACACCAGAGTCTGGA
CCTGGCACCAGCACAGAGCCATCCGAGGGCTCTGCCCCAGGCTCTCCTGCA
GGCAGCCCTACCTCCACCGAAGAGGGCACCAGCACAGAGCCTTCTGAGGGC
AGCGCCCCAGGCACCTCTACAGAGCCAAGCGAGCTCGAGGACAAGAAGTAC
AGCATCGGCCTGGCCATCGGCACCAACTCTGTGGGCTGGGCCGTGATCACC
GACGAGTACAAGGTGCCCAGCAAGAAATTCAAGGTGCTGGGCAACACCGAC
CGGCACAGCATCAAGAAGAACCTGATCGGAGCCCTGCTGTTCGACAGCGGC
GAAACAGCCGAGGCCACCCGGCTGAAGAGAACCGCCAGAAGAAGATACACC
AGACGGAAGAACCGGATCTGCTATCTGCAAGAGATCTTCAGCAACGAGATG
GCCAAGGTGGACGACAGCTTCTTCCACAGACTGGAAGAGTCCTTCCTGGTG
GAAGAGGATAAGAAGCACGAGCGGCACCCCATCTTCGGCAACATCGTGGAC
GAGGTGGCCTACCACGAGAAGTACCCCACCATCTACCACCTGAGAAAGAAA
CTGGTGGACAGCACCGACAAGGCCGACCTGCGGCTGATCTATCTGGCCCTG
GCCCACATGATCAAGTTCCGGGGCCACTTCCTGATCGAGGGCGACCTGAAC
CCCGACAACAGCGACGTGGACAAGCTGTTCATCCAGCTGGTGCAGACCTAC
AACCAGCTGTTCGAGGAAAACCCCATCAACGCCAGCGGCGTGGACGCCAAG
GCCATCCTGTCTGCCAGACTGAGCAAGAGCAGACGGCTGGAAAATCTGATC
GCCCAGCTGCCCGGCGAGAAGAAGAATGGCCTGTTCGGCAACCTGATTGCC
CTGAGCCTGGGCCTGACCCCCAACTTCAAGAGCAACTTCGACCTGGCCGAG
GATGCCAAACTGCAGCTGAGCAAGGACACCTACGACGACGACCTGGACAAC
CTGCTGGCCCAGATCGGCGACCAGTACGCCGACCTGTTTCTGGCCGCCAAG
AACCTGTCCGACGCCATCCTGCTGAGCGACATCCTGAGAGTGAACACCGAG
ATCACCAAGGCCCCCCTGAGCGCCTCTATGATCAAGAGATACGACGAGCAC
CACCAGGACCTGACCCTGCTGAAAGCTCTCGTGCGGCAGCAGCTGCCTGAG
AAGTACAAAGAGATTTTCTTCGACCAGAGCAAGAACGGCTACGCCGGCTAC
ATTGACGGCGGAGCCAGCCAGGAAGAGTTCTACAAGTTCATCAAGCCCATC
CTGGAAAAGATGGACGGCACCGAGGAACTGCTCGTGAAGCTGAACAGAGAG
GACCTGCTGCGGAAGCAGCGGACCTTCGACAACGGCAGCATCCCCCACCAG
ATCCACCTGGGAGAGCTGCACGCCATTCTGCGGCGGCAGGAAGATTTTTAC
CCATTCCTGAAGGACAACCGGGAAAAGATCGAGAAGATCCTGACCTTCCGC
ATCCCCTACTACGTGGGCCCTCTGGCCAGGGGAAACAGCAGATTCGCCTGG
ATGACCAGAAAGAGCGAGGAAACCATCACCCCCTGGAACTTCGAGGAAGTG
GTGGACAAGGGCGCTTCCGCCCAGAGCTTCATCGAGCGGATGACCAACTTC
GATAAGAACCTGCCCAACGAGAAGGTGCTGCCCAAGCACAGCCTGCTGTAC
GAGTACTTCACCGTGTATAACGAGCTGACCAAAGTGAAATACGTGACCGAG
GGAATGAGAAAGCCCGCCTTCCTGAGCGGCGAGCAGAAAAAGGCCATCGTG
GACCTGCTGTTCAAGACCAACCGGAAAGTGACCGTGAAGCAGCTGAAAGAG
GACTACTTCAAGAAAATCGAGTGCTTCGACTCCGTGGAAATCTCCGGCGTG
GAAGATCGGTTCAACGCCTCCCTGGGCACATACCACGATCTGCTGAAAATT
ATCAAGGACAAGGACTTCCTGGACAATGAGGAAAACGAGGACATTCTGGAA
GATATCGTGCTGACCCTGACACTGTTTGAGGACAGAGAGATGATCGAGGAA
CGGCTGAAAACCTATGCCCACCTGTTCGACGACAAAGTGATGAAGCAGCTG
AAGCGGCGGAGATACACCGGCTGGGGCAGGCTGAGCCGGAAGCTGATCAAC
GGCATCCGGGACAAGCAGTCCGGCAAGACAATCCTGGATTTCCTGAAGTCC
GACGGCTTCGCCAACAGAAACTTCATGCAGCTGATCCACGACGACAGCCTG
ACCTTTAAAGAGGACATCCAGAAAGCCCAGGTGTCCGGCCAGGGCGATAGC
CTGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCGG
CACAAGCCCGAGAACATCGTGATCGAAATGGCCAGAGAGAACCAGACCACC
CAGAAGGGACAAGAACAGCCGCGAGAGAATGAAGCGGATCGAAGAGGGC
ATCAAAGAGCTGGGCAGCCAGATCCTGAAAGAACACCCCGTGGAAAACACC
CAGCTGCAGAACGAGAAGCTGTACCTGTACTACCTGCAGAATGGGCGGGAT
ATGTACGTGGACCAGGAACTGGACATCAACCGGCTGTCCGACTACGATGTG
GACGCCATCGTGCCTCAGAGCTTTCTGAAGGACGACTCCATCGACAACAAG
GTGCTGACCAGAAGCGACAAGAACCGGGGCAAGAGCGACAACGTGCCCTCC
GAAGAGGTCGTGAAGAAGATGAAGAACTACTGGCGGCAGCTGCTGAACGCC
AAGCTGATTACCCAGAGAAAGTTCGACAATCTGACCAAGGCCGAGAGAGGC
GGCCTGAGCGAACTGGATAAGGCCGGCTTCATCAAGAGACAGCTGGTGGAA
ACCCGGCAGATCACAAAGCACGTGGCACAGATCCTGGACTCCCGGATGAAC
ACTAAGTACGACGAGAATGACAAGCTGATCCGGGAAGTGAAAGTGATCACC
CTGAAGTCCAAGCTGGTGTCCGATTTCCGGAAGGATTTCCAGTTTTACAAA
GTGCGCGAGATCAACAACTACCACCACGCCCACGACGCCTACCTGAACGCC
GTCGTGGGAACCGCCCTGATCAAAAAGTACCCTAAGCTGGAAAGCGAGTTC
GTGTACGGCGACTACAAGGTGTACGACGTGCGGAAGATGATCGCCAAGAGC
GAGCAGGAAATCGGCAAGGCTACCGCCAAGTACTTCTTCTACAGCAACATC
ATGAACTTTTTTCAAGACCGAGATTACCCTGGCCAACGGCGAGATCCGGAAG
CGGCCTCTGATCGAGACAAACGGCGAAACCGGGGAGATCGTGTGGGATAAG |

TABLE 7-continued sequences of exemplary epigenetic editors

| SEQ ID NO | Description | Sequence |
|---|---|---|
| | | GGCCGGGATTTTGCCACCGTGCGGAAAGTGCTGAGCATGCCCCAAGTGAAT<br>ATCGTGAAAAAGACCGAGGTGCAGACAGGCGGCTTCAGCAAAGAGTCTATC<br>CTGCCCAAGAGGAACAGCGATAAGCTGATCGCCAGAAAGAAGGACTGGGAC<br>CCTAAGAAGTACGGCGGCTTCGACAGCCCCACCGTGGCCTATTCTGTGCTG<br>GTGGTGGCCAAAGTGGAAAAGGGCAAGTCCAAGAAACTGAAGAGTGTGAAA<br>GAGCTGCTGGGGATCACCATCATGGAAAGAAGCAGCTTCGAGAAGAATCCC<br>ATCGACTTTCTGGAAGCCAAGGGCTACAAAGAAGTGAAAAAGGACCTGATC<br>ATCAAGCTGCCTAAGTACTCCCTGTTCGAGCTGGAAAACGGCCGGAAGAGA<br>ATGCTGGCCTCTGCCGGCGAACTGCAGAAGGGAAACGAACTGGCCCTGCCC<br>TCCAAATATGTGAACTTCCTGTACCTGGCCAGCCACTATGAGAAGCTGAAG<br>GGCTCCCCCGAGGATAATGAGCAGAAACAGCTGTTTGTGGAACAGCACAAG<br>CACTACCTGGACGAGATCATCGAGCAGATCAGCGAGTTCTCCAAGAGAGTG<br>ATCCTGGCCGACGCTAATCTGGACAAAGTGCTGTCCGCCTACAACAAGCAC<br>CGGGATAAGCCCATCAGAGAGCAGGCCGAGAATATCATCCACCTGTTTACC<br>CTGACCAATCTGGGAGCCCCTGCCGCCTTCAAGTACTTTGACACCACCATC<br>GACCGGAAGAGGTACACCAGCACCAAAGAGGTGCTGGACGCCACCCTGATC<br>CACCAGAGCATCACCGGCCTGTACGAGACACGGATCGACCTGTCTCAGCTG<br>GGAGGCGACAGCCCCAAGAAGAAGAGAAAGGTGGGAGTCGACGGATCCAGC<br>GGCTCCGAGACCCCAGGCACATCTGAGAGCGCCACCCCTGAGTCCACCGGT<br>ATGAACAATTCACAGGGGAGAGTGACATTCGAAGACGTGACCGTGAACTTC<br>ACCCAGGGAGAATGGCAGCGCTTGAACCCAGAACAAAGGAACCTCTATCGG<br>GACGTGATGCTGGAAAACTACTCAAATTTGGTGAGCGTTGGGCAGGGTGAG<br>ACCACTAAGCCTGACGTGATCCTGAGATTGGAACAGGGCAAGGAGCCTTGG<br>CTCGAGGAAGAGGAAGTCCTGGGCTCAGGGAGGGCCGAGAAAACGGTGAT<br>ATAGGAGGCCAGATATGGAAGCCTAAGGACGTCAAGGAGAGCCTGAGCGCT<br>CCCAAGAAGAAAAGGAAGGTCCCAAAGAAAAAAAGAAAGGTGTGA |

Table 8 below lists components of the fusion polypeptide PLA001 and their corresponding amino acid position in the fusion polypeptide sequence (SEQ ID No. 481) set forth in Table 7.

TABLE 8 annotation of PLA001 amino acid sequence

| | Type | Start | End | Length |
|---|---|---|---|---|
| SV40 NLS | CDS | 2 | 8 | 7 |
| SV40 NLS | CDS | 9 | 15 | 7 |
| DNMT3A | CDS | 17 | 317 | 301 |
| Linker | CDS | 318 | 344 | 27 |
| DNMT3L full-length | CDS | 345 | 730 | 386 |
| XTEN80 | CDS | 731 | 810 | 80 |
| dCas9 | CDS | 811 | 2180 | 1370 |
| NLS | CDS | 2181 | 2187 | 7 |
| XTEN16 | CDS | 2188 | 2208 | 21 |
| ZN627 | CDS | 2211 | 2290 | 80 |
| FLAG | CDS | 2293 | 2300 | 8 |
| SV40 NLS | CDS | 2302 | 2308 | 7 |
| SV40 NLS | CDS | 2309 | 2315 | 7 |

Table 9 below lists components of the polynucleotide encoding the fusion polypeptide PLA001 and their corresponding nucleotide position in the polynucleotide sequence (SEQ ID No. 482) set forth in Table 7.

TABLE 9 annotation of PLA001 polynucleotide sequence

| Name | Type | Minimum | Maximum | Length |
|---|---|---|---|---|
| SV40 NLS | CDS | 4 | 24 | 21 |
| SV40 NLS | CDS | 25 | 44 | 20 |
| DNMT3A | CDS | 49 | 951 | 903 |
| Linker | CDS | 952 | 1032 | 81 |

TABLE 9-continued annotation of PLA001 polynucleotide sequence

| Name | Type | Minimum | Maximum | Length |
|---|---|---|---|---|
| DNMT3L full-length | CDS | 1033 | 2190 | 1158 |
| XTEN80 | CDS | 2191 | 2430 | 240 |
| dCas9 | CDS | 2431 | 6540 | 4110 |
| NLS | CDS | 6541 | 6561 | 21 |
| XTEN16 | CDS | 6562 | 6624 | 63 |
| ZN627 | CDS | 6631 | 6870 | 240 |
| FLAG | CDS | 6877 | 6900 | 24 |
| SV40 NLS | CDS | 6904 | 6924 | 21 |
| SV40 NLS | CDS | 6925 | 6945 | 21 |

Table 10 below lists components of the fusion polypeptide PLA002 and their corresponding amino acid position in the fusion polypeptide sequence (SEQ ID No. 483) set forth in Table 7.

TABLE 10 annotation of PLA002 amino acid sequence

| Name | Type | Minimum | Maximum | Length |
|---|---|---|---|---|
| SV40 NLS | CDS | 2 | 8 | 7 |
| SV40 NLS | CDS | 9 | 15 | 7 |
| DNMT3A | CDS | 17 | 317 | 301 |
| Linker | CDS | 318 | 344 | 27 |
| DNMT3L full-length | CDS | 345 | 730 | 386 |
| XTEN80 | CDS | 731 | 810 | 80 |
| dCas9 | CDS | 811 | 2180 | 1370 |
| NLS | CDS | 2181 | 2187 | 7 |
| XTEN16 | CDS | 2188 | 2208 | 21 |
| ZIM3 | CDS | 2211 | 2310 | 100 |
| FLAG | CDS | 2313 | 2320 | 8 |
| SV40 NLS | CDS | 2322 | 2328 | 7 |
| SV40 NLS | CDS | 2329 | 2335 | 7 |

Table 11 below lists components of the polynucleotide encoding the fusion polypeptide PLA002 and their corresponding nucleotide position in the polynucleotide sequence (SEQ ID No. 484) set forth in Table 7.

TABLE 11 annotation of PLA002 polynucleotide sequence

| Name | Type | Minimum | Maximum | Length |
|---|---|---|---|---|
| SV40 NLS | CDS | 4 | 24 | 21 |
| SV40 NLS | CDS | 25 | 45 | 21 |
| DNMT3A | CDS | 49 | 951 | 903 |
| Linker | CDS | 952 | 1032 | 81 |
| DNMT3L full-length | CDS | 1033 | 2190 | 1158 |

TABLE 11-continued annotation of PLA002 polynucleotide sequence

| Name | Type | Minimum | Maximum | Length |
|---|---|---|---|---|
| XTEN80 | CDS | 2191 | 2430 | 240 |
| dCas9 | CDS | 2431 | 6540 | 4110 |
| NLS | CDS | 6541 | 6561 | 21 |
| XTEN16 | CDS | 6562 | 6624 | 63 |
| ZIM3 | CDS | 6631 | 6930 | 300 |
| FLAG | CDS | 6937 | 6960 | 24 |
| SV40 NLS | CDS | 6964 | 6984 | 21 |
| SV40 NLS | CDS | 6985 | 7005 | 21 |
| stop | terminator | 7006 | 7008 | 3 |

Table 12 below provides gRNA sequence tested.

TABLE 12

Exemplary gRNA sequences

| SEQ IDs | Target domain sequence | SEQ IDs | gRNA sequence |
|---|---|---|---|
| 333 | CCTGCTGGTGGCTCCAGTTC | 1093 | CCUGCUGGUGGCUCCAGUUCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 334 | CTGAACTGGAGCCACCAGCA | 1094 | CUGAACUGGAGCCACCAGCAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 335 | CCTGAACTGGAGCCACCAGC | 1095 | CCUGAACUGGAGCCACCAGCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 336 | CCTCGAGAAGATTGACGATA | 1096 | CCUCGAGAAGAUUGACGAUAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 337 | TCGTCAATCTTCTCGAGGAT | 1097 | UCGUCAAUCUUCUCGAGGAUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 338 | CGTCAATCTTCTCGAGGATT | 1098 | CGUCAAUCUUCUCGAGGAUUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 339 | GTCAATCTTCTCGAGGATTG | 1099 | GUCAAUCUUCUCGAGGAUUGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 340 | AACATGGAGAACATCACATC | 1100 | AACAUGGAGAACAUCACAUCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 341 | AACATCACATCAGGATTCCT | 1101 | AACAUCACAUCAGGAUUCCUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 342 | CTAGACTCTGCGGTATTGTG | 1102 | CUAGACUCUGCGGUAUUGUGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 343 | TACCGCAGAGTCTAGACTCG | 1103 | UACCGCAGAGUCUAGACUCGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 344 | CGCAGAGTCTAGACTCGTGG | 1104 | CGCAGAGUCUAGACUCGUGGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 345 | CACCACGAGTCTAGACTCTG | 1105 | CACCACGAGUCUAGACUCUGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 346 | TGGACTTCTCTCAATTTTCT | 1106 | UGGACUUCUCUCAAUUUUCUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 347 | GGACTTCTCTCAATTTTCTA | 1107 | GGACUUCUCUCAAUUUUCUAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 348 | GACTTCTCTCAATTTTCTAG | 1108 | GACUUCUCUCAAUUUUCUAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 349 | ACTTCTCTCAATTTTCTAGG | 1109 | ACUUCUCUCAAUUUUCUAGGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 350 | CGAATTTTGGCCAAGACACA | 1110 | CGAAUUUUGGCCAAGACACAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 351 | AGGTTGGGACTGCGAATTT | 1111 | AGGUUGGGACUGCGAAUUUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 352 | GGCATAGCAGCAGGATGAAG | 1112 | GGCAUAGCAGCAGGAUGAAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 353 | AGAAGATGAGGCATAGCAGC | 1113 | AGAAGAUGAGGCAUAGCAGCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 354 | GCTATGCCTCATCTTCTTGT | 1114 | GCUAUGCCUCAUCUUCUUGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 355 | GAAGAACCAACAAGAAGATG | 1115 | GAAGAACCAACAAGAAGAUGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 356 | CATCTTCTTGTTGGTTCTTC | 1116 | CAUCUUCUUGUUGGUUCUUCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 357 | CCCGTTTGTCCTCTAATTCC | 1117 | CCCGUUUGUCCUCUAAUUCCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 358 | CCTGGAATTAGAGGACAAAC | 1118 | CCUGGAAUUAGAGGACAAACGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 359 | TCCTGGAATTAGAGGACAAA | 1119 | UCCUGGAAUUAGAGGACAAAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 360 | TACTAGTGCCATTTGTTCAG | 1120 | UACUAGUGCCAUUUGUUCAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 361 | CCATTTGTTCAGTGGTTCGT | 1121 | CCAUUUGUUCAGUGGUUCGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 362 | CATTTGTTCAGTGGTTCGTA | 1122 | CAUUUGUUCAGUGGUUCGUAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 363 | CCTACGAACCACTGAACAAA | 1123 | CCUACGAACCACUGAACAAAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 364 | TTTCAGTTATATGGATGATG | 1124 | UUUCAGUUAUAUGGAUGAUGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 365 | CAAAAGAAAATTGGTAACAG | 1125 | CAAAAGAAAAUUGGUAACAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 366 | TACCAATTTTCTTTTGTCTT | 1126 | UACCAAUUUUCUUUUGUCUUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 367 | ACCAATTTTCTTTTGTCTTT | 1127 | ACCAAUUUUCUUUUGUCUUUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 368 | ACCCAAAGACAAAAGAAAAT | 1128 | ACCCAAAGACAAAAGAAAAUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 369 | TGACATACTTTCCAATCAAT | 1129 | UGACAUACUUUCCAAUCAAUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 370 | CACTTTCTCGCCAACTTACA | 1130 | CACUUUCUCGCCAACUUACAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 371 | CACAGAAAGGCCTTGTAAGT | 1131 | CACAGAAAGGCCUUGUAAGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 372 | TGAACCTTTACCCCGTTGCC | 1132 | UGAACCUUUACCCCGUUGCCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 373 | GGGCAACGGGGTAAAGGTTC | 1133 | GGGCAACGGGGUAAAGGUUCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 374 | TTTACCCCGTTGCCCGGCAA | 1134 | UUUACCCCGUUGCCCGGCAAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 375 | GTTGCCGGGC AACGGGGTAA | 1135 | GUUGCCGGGCAACGGGGUAAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 376 | CCCGTTGCCC GGCAACGGCC | 1136 | CCCGUUGCCCGGCAACGGCCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 377 | CTGGCCGTTG CCGGGCAACG | 1137 | CUGGCCGUUGCCGGGCAACGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 378 | CCTGGCCGTT GCCGGGCAAC | 1138 | CCUGGCCGUUGCCGGGCAACGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 379 | ACCTGGCCGT TGCCGGGCAA | 1139 | ACCUGGCCGUUGCCGGGCAAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 380 | GCACAGACCT GGCCGTTGCC | 1140 | GCACAGACCUGGCCGUUGCCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 381 | GGCACAGACC TGGCCGTTGC | 1141 | GGCACAGACCUGGCCGUUGCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 382 | GCAAACACTT GGCACAGACC | 1142 | GCAAACACUUGGCACAGACCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 383 | GGGTTGCGTC AGCAAACACT | 1143 | GGGUUGCGUCAGCAAACACUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 384 | TTTGCTGACG CAACCCCCAC | 1144 | UUUGCUGACGCAACCCCCACGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 385 | CTGACGCAAC CCCCACTGGC | 1145 | CUGACGCAACCCCCACUGGCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 386 | TGACGCAACC CCCACTGGCT | 1146 | UGACGCAACCCCCACUGGCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 387 | GACGCAACCC CCACTGGCTG | 1147 | GACGCAACCCCCACUGGCUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 388 | AACCCCCACT GGCTGGGGCT | 1148 | AACCCCCACUGGCUGGGGCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 389 | TCCTCTGCCG ATCCATACTG | 1149 | UCCUCUGCCGAUCCAUACUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 390 | TCCGCAGTAT GGATCGGCAG | 1150 | UCCGCAGUAUGGAUCGGCAGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 391 | AGGAGTTCCG CAGTATGGAT | 1151 | AGGAGUUCCGCAGUAUGGAUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 392 | CGGCTAGGAG TTCCGCAGTA | 1152 | CGGCUAGGAGUUCCGCAGUAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 393 | TGCGAGCAAA ACAAGCGGCT | 1153 | UGCGAGCAAAACAAGCGGCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 394 | CCGCTTGTTT TGCTCGCAGC | 1154 | CCGCUUGUUUUGCUCGCAGCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 395 | CCTGCTGCGA GCAAAACAAG | 1155 | CCUGCUGCGAGCAAAACAAGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 396 | TGTTTTGCTC GCAGCAGGTC | 1156 | UGUUUUGCUCGCAGCAGGUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 397 | GCAGCACAGC CTAGCAGCCA | 1157 | GCAGCACAGCCUAGCAGCCAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 398 | TGCTAGGCTG TGCTGCCAAC | 1158 | UGCUAGGCUGUGCUGCCAACGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 399 | GCTGCCAACTGGATCCTGCG | 1159 | GCUGCCAACUGGAUCCUGCGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 400 | CTGCCAACTGGATCCTGCGC | 1160 | CUGCCAACUGGAUCCUGCGCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 401 | CGTCCCGCGCAGGATCCAGT | 1161 | CGUCCCGCGCAGGAUCCAGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 402 | AAACAAGGACGTCCCGCGC | 1162 | AAACAAGGACGUCCCGCGCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 403 | GTCCTTTGTTTACGTCCCGT | 1163 | GUCCUUUGUUUACGUCCCGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 404 | CGCCGACGGGACGTAAACAA | 1164 | CGCCGACGGGACGUAAACAAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 405 | TGCCGTTCCGACCGACCACG | 1165 | UGCCGUUCCGACCGACCACGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 406 | AGGTGCGCCCCGTGGTCGGT | 1166 | AGGUGCGCCCCGUGGUCGGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 407 | AGAGAGGTGCGCCCCGTGGT | 1167 | AGAGAGGUGCGCCCCGUGGUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 408 | GTAAAGAGAGGTGCGCCCCG | 1168 | GUAAAGAGAGGUGCGCCCCGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 409 | GGGGCGCACCTCTCTTTACG | 1169 | GGGGCGCACCUCUCUUUACGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 410 | CGGGGAGTCCGCGTAAAGAG | 1170 | CGGGGAGUCCGCGUAAAGAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 411 | CAGATGAGAAGGCACAGACG | 1171 | CAGAUGAGAAGGCACAGACGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 412 | GTCTGTGCCTTCTCATCTGC | 1172 | GUCUGUGCCUUCUCAUCUGCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 413 | GGCAGATGAGAAGGCACAGA | 1173 | GGCAGAUGAGAAGGCACAGAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 414 | GCAGATGAGAAGGCACAGAC | 1174 | GCAGAUGAGAAGGCACAGACGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 415 | ACACGGTCCGGCAGATGAGA | 1175 | ACACGGUCCGGCAGAUGAGAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 416 | GAAGCGAAGTGCACACGGTC | 1176 | GAAGCGAAGUGCACACGGUCGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 417 | GAGGTGAAGCGAAGTGCACA | 1177 | GAGGUGAAGCGAAGUGCACAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 418 | CTTCACCTCTGCACGTCGCA | 1178 | CUUCACCUCUGCACGUCGCAGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 419 | GGTCTCCATGCGACGTGCAG | 1179 | GGUCUCCAUGCGACGUGCAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 420 | TGCCCAAGGTCTTACATAAG | 1180 | UGCCCAAGGUCUUACAUAAGGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 421 | GTCCTCTTATGTAAGACCTT | 1181 | GUCCUCUUAUGUAAGACCUUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |
| 422 | AGTCCTCTTATGTAAGACCT | 1182 | AGUCCUCUUAUGUAAGACCUGUUUAAGAGCUAAGCUGGAAACAGCAUAGCAAGUUUAAAUAAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 423 | GTCTTACATA AGAGGACTCT | 1183 | GUCUUACAUAAGAGGACUCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 424 | AATGTCAACG ACCGACCTTG | 1184 | AAUGUCAACGACCGACCUUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 425 | TTTGAAGTAT GCCTCAAGGT | 1185 | UUUGAAGUAUGCCUCAAGGUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 426 | AGTCTTTGAA GTATGCCTCA | 1186 | AGUCUUUGAAGUAUGCCUCAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 427 | AAGACTGTTT GTTTAAAGAC | 1187 | AAGACUGUUUGUUUAAAGACGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 428 | AGACTGTTTG TTTAAAGACT | 1188 | AGACUGUUUGUUUAAAGACUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 429 | CTGTTTGTTT AAAGACTGGG | 1189 | CUGUUUGUUUAAAGACUGGGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 430 | GTTTAAAGAC TGGGAGGAGT | 1190 | GUUUAAAGACUGGGAGGAGUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 431 | TCTTTGTACT AGGAGGCTGT | 1191 | UCUUUGUACUAGGAGGCUGUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 432 | AGGAGGCTGT AGGCATAAAT | 1192 | AGGAGGCUGUAGGCAUAAAUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 433 | GTGAAAAAGT TGCATGGTGC | 1193 | GUGAAAAAGUUGCAUGGUGCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 434 | GCAGAGGTGA AAAAGTTGCA | 1194 | GCAGAGGUGAAAAAGUUGCAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 435 | AACAAGAGAT GATTAGGCAG | 1195 | AACAAGAGAUGAUUAGGCAGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 436 | GACATGAACA AGAGATGATT | 1196 | GACAUGAACAAGAGAUGAUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 437 | AGCTTGGAGG CTTGAACAGT | 1197 | AGCUUGGAGGCUUGAACAGUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 438 | CAAGCCTCCA AGCTGTGCCT | 1198 | CAAGCCUCCAAGCUGUGCCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 439 | AAGCCTCCAA GCTGTGCCTT | 1199 | AAGCCUCCAAGCUGUGCCUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 440 | CCTCCAAGCT GTGCCTTGGG | 1200 | CCUCCAAGCUGUGCCUUGGGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 441 | CCACCCAAGG CACAGCTTGG | 1201 | CCACCCAAGGCACAGCUUGGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 442 | AGCTGTGCCT TGGGTGGCTT | 1202 | AGCUGUGCCUUGGGUGGCUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 443 | AAGCCACCCA AGGCACAGCT | 1203 | AAGCCACCCAAGGCACAGCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 444 | GCTGTGCCTT GGGTGGCTTT | 1204 | GCUGUGCCUUGGGUGGCUUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 445 | CTGTGCCTTG GGTGGCTTTG | 1205 | CUGUGCCUUGGGUGGCUUUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 446 | TAGCTCCAAA TTCTTTATAA | 1206 | UAGCUCCAAAUUCUUUAUAAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 447 | GTAGCTCCAA ATTCTTTATA | 1207 | GUAGCUCCAAAUUCUUUAUAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 448 | TAAAGAATTT GGAGCTACTG | 1208 | UAAAGAAUUUGGAGCUACUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 449 | ATGACTCTAG CTACCTGGGT | 1209 | AUGACUCUAGCUACCUGGGUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 450 | CACATTTCTT GTCTCACTTT | 1210 | CACAUUUCUUGUCUCACUUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 451 | TAGTTTCCGG AAGTGTTGAT | 1211 | UAGUUUCCGGAAGUGUUGAUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 452 | CGTCTAACAA CAGTAGTTTC | 1212 | CGUCUAACAACAGUAGUUUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 453 | ACTACTGTTG TTAGACGACG | 1213 | ACUACUGUUGUUAGACGACGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 454 | CTGTTGTTAG ACGACGAGGC | 1214 | CUGUUGUUAGACGACGAGGCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 455 | CGAGGGAGTT CTTCTTCTAG | 1215 | CGAGGGAGUUCUUCUUCUAGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 456 | GCGAGGGAGT TCTTCTTCTA | 1216 | GCGAGGGAGUUCUUCUUCUAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 457 | GGCGAGGGAG TTCTTCTTCT | 1217 | GGCGAGGGAGUUCUUCUUCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 458 | CTCCCTCGCC TCGCAGACGA | 1218 | CUCCCUCGCCUCGCAGACGAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 459 | GACCTTCGTC TGCGAGGCGA | 1219 | GACCUUCGUCUGCGAGGCGAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 460 | AGACCTTCGT CTGCGAGGCG | 1220 | AGACCUUCGUCUGCGAGGCGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 461 | GATTGAGACC TTCGTCTGCG | 1221 | GAUUGAGACCUUCGUCUGCGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 462 | GATTGAGATC TTCTGCGACG | 1222 | GAUUGAGAUCUUCUGCGACGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 463 | GTCGCAGAAG ATCTCAATCT | 1223 | GUCGCAGAAGAUCUCAAUCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 464 | TCGCAGAAGA TCTCAATCTC | 1224 | UCGCAGAAGAUCUCAAUCUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 465 | ATATGGTGAC CCACAAATG | 1225 | AUAUGGUGACCCACAAAAUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 466 | TTTGTGGGTC ACCATATTCT | 1226 | UUUGUGGGUCACCAUAUUCUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 467 | TTGTGGGTCA CCATATTCTT | 1227 | UUGUGGGUCACCAUAUUCUUGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 468 | GCTGGATCCA ACTGGTGGTC | 1228 | GCUGGAUCCAACUGGUGGUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 469 | CACCCCAAAA GGCCTCCGTG | 1229 | CACCCCAAAAGGCCUCCGUGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 470 | CCTTTTGGGG TGGAGCCCTC | 1230 | CCUUUUGGGGUGGAGCCCUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |

TABLE 12-continued

Exemplary gRNA sequences

| SEQ IDs | Target domain sequence | SEQ IDs | gRNA sequence |
|---|---|---|---|
| 471 | CCTGAGGGCT CCACCCCAAA | 1231 | CCUGAGGGCUCCACCCCAAAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 472 | GGGGTGGAGC CCTCAGGCTC | 1232 | GGGGUGGAGCCCUCAGGCUCGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 473 | GGGTGGAGCC CTCAGGCTCA | 1233 | GGGUGGAGCCCUCAGGCUCAGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 474 | CGATTGGTGG AGGCAGGAGG | 1234 | CGAUUGGUGGAGGCAGGAGGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |
| 475 | CTCATCCTCA GGCCATGCAG | 1235 | CUCAUCCUCAGGCCAUGCAGGUUUAAGAGCUAAGCUGGAAACAGCAUAGCAAGUUUAAAU AAGGCUAGUCCGUUAUCAACUUGAAAAAGUGGCACCGAGUCGGUGCUUUUUU |

TABLE 13

Exemplary target domain sequences and effect on HbeAg and HbsAg expression guide RNA

| SEQ IDs | Associated guide RNA name (if applicable) | Target domain sequence | HbeAg (%expression of non targeting control) | HbsAg (%expression of non targeting control) |
|---|---|---|---|---|
| 334 | gRNA#001 | CTGAACTGGAGCCACCAGCA | 27.77203753 | 23.4507853 |
| 335 | gRNA#002 | CCTGAACTGGAGCCACCAGC | 41.3794605 | 42.3814023 |
| 333 | | CCTGCTGGTGGCTCCAGTTC | 65.36067834 | 43.2303179 |
| 336 | | CCTCGAGAAGATTGACGATA | 82.8943107 | 72.648219 |
| 337 | | TCGTCAATCTTCTCGAGGAT | 45.82985382 | 59.7223204 |
| 338 | | CGTCAATCTTCTCGAGGATT | 70.38176383 | 73.1313979 |
| 339 | | GTCAATCTTCTCGAGGATTG | 51.92713248 | 54.330978 |
| 340 | | AACATGGAGAACATCACATC | 79.31612772 | 80.8981286 |
| 341 | | AACATCACATCAGGATTCCT | 41.40633262 | 37.5509299 |
| 342 | | CTAGACTCTGCGGTATTGTG | 48.56267424 | 41.5330827 |
| 345 | gRNA#003 | CACCACGAGTCTAGACTCTG | 44.43853541 | 40.8553881 |
| 343 | | TACCGCAGAGTCTAGACTCG | 49.18078863 | 56.151898 |
| 344 | | CGCAGAGTCTAGACTCGTGG | 52.41583101 | 57.2264647 |
| 346 | | TGGACTTCTCTCAATTTTCT | 49.58564481 | 51.1350719 |
| 347 | | GGACTTCTCTCAATTTTCTA | 76.16671739 | 79.1684976 |
| 348 | | GACTTCTCTCAATTTTCTAG | 49.79317156 | 54.1540479 |
| 349 | | ACTTCTCTCAATTTTCTAGG | 69.66968253 | 77.4650531 |
| 350 | | CGAATTTTGGCCAAGACACA | 53.53282063 | 54.0024954 |
| 371 | gRNA#004 | CACAGAAAGGCCTTGTAAGT | 42.35590319 | 41.6928086 |
| 370 | | CACTTTCTCGCCAACTTACA | 53.25960148 | 55.120666 |
| 373 | gRNA#005 | GGGCAACGGGGTAAAGGTTC | 36.54111842 | 42.8120918 |
| 375 | gRNA#006 | GTTGCCGGGCAACGGGGTAA | 41.20322042 | 38.1885911 |
| 377 | | CTGGCCGTTGCCGGGCAACG | 57.27834882 | 60.830473 |

TABLE 13-continued

Exemplary target domain sequences and effect on HbeAg and HbsAg expression guide RNA

| SEQ IDs | Associated guide RNA name (if applicable) | Target domain sequence | HbeAg (%expression of non targeting control) | HbsAg (%expression of non targeting control) |
|---|---|---|---|---|
| 372 | | TGAACCTTTACCCCGTTGCC | 48.16509881 | 60.952804 |
| 378 | | CCTGGCCGTTGCCGGGCAAC | 56.34234102 | 65.50842 |
| 379 | | ACCTGGCCGTTGCCGGGCAA | 54.10829257 | 53.324749 |
| 374 | | TTTACCCCGTTGCCCGGCAA | 56.72089131 | 62.6906255 |
| 380 | | GCACAGACCTGGCCGTTGCC | 42.46818432 | 47.3720079 |
| 381 | | GGCACAGACCTGGCCGTTGC | 72.65381719 | 77.2400091 |
| 376 | | CCCGTTGCCGGCAACGGCC | 50.93018919 | 61.086777 |
| 382 | | GCAAACACTTGGCACAGACC | 57.0196485 | 69.491449 |
| 383 | | GGGTTGCGTCAGCAAACACT | 49.73518831 | 54.7510029 |
| 384 | | TTTGCTGACGCAACCCCCAC | 41.79724731 | 50.0362297 |
| 385 | | CTGACGCAACCCCCACTGGC | 36.90727137 | 36.8247762 |
| 386 | | TGACGCAACCCCCACTGGCT | 46.49501492 | 59.6959921 |
| 387 | | GACGCAACCCCCACTGGCTG | 40.09200943 | 51.4756937 |
| 388 | | AACCCCCACTGGCTGGGCT | 61.82883278 | 79.8761795 |
| 390 | gRNA#007 | TCCGCAGTATGGATCGGCAG | 26.33655968 | 33.7255842 |
| 391 | gRNA#008 | AGGAGTTCCGCAGTATGGAT | 28.49512897 | 40.080391 |
| 389 | gRNA#009 | TCCTCTGCCGATCCATACTG | 28.45399116 | 42.735093 |
| 392 | | CGGCTAGGAGTTCCGCAGTA | 56.5241517 | 66.9060644 |
| 393 | gRNA#010 | TGCGAGCAAAACAAGCGGCT | 41.5479747 | 40.5350018 |
| 395 | | CCTGCTGCGAGCAAAACAAG | 36.4525077 | 50.516964 |
| 394 | | CCGCTTGTTTTGCTCGCAGC | 108.4014077 | 90.5082399 |
| 396 | | TGTTTTGCTCGCAGCAGGTC | 68.78508191 | 75.7537996 |
| 397 | | GCAGCACAGCCTAGCAGCCA | 78.73231487 | 68.3785588 |
| 398 | | TGCTAGGCTGTGCTGCCAAC | 59.52249922 | 69.0333267 |
| 401 | | CGTCCCGCGCAGGATCCAGT | 52.51634701 | 49.5876502 |
| 399 | | GCTGCCAACTGGATCCTGCG | 75.81794218 | 89.0162904 |
| 400 | | CTGCCAACTGGATCCTGCGC | 77.79441236 | 73.9461516 |
| 402 | | AAACAAAGGACGTCCCGCGC | 67.52500576 | 72.6685954 |
| 404 | | CGCCGACGGGACGTAAACAA | 77.77475148 | 70.288774 |
| 403 | | GTCCTTTGTTTACGTCCCGT | 94.99070926 | 103.867949 |
| 406 | | AGGTGCGCCCCGTGGTCGGT | 68.80565242 | 65.4335257 |
| 407 | | AGAGAGGTGCGCCCCGTGGT | 42.18514493 | 55.1199635 |
| 408 | | GTAAAGAGAGGTGCGCCCCG | 53.39922155 | 55.7151401 |
| 410 | | CGGGGAGTCCGCGTAAAGAG | 52.63946411 | 66.9249801 |
| 409 | | GGGGCGCACCTCTCTTTACG | 72.81702761 | 66.4993545 |
| 411 | gRNA#011 | CAGATGAGAAGGCACAGACG | 32.31425506 | 44.762352 |

TABLE 13-continued

Exemplary target domain sequences and effect on HbeAg and HbsAg expression guide RNA

| SEQ IDs | Associated guide RNA name (if applicable) | Target domain sequence | HbeAg (%expression of non targeting control) | HbsAg (%expression of non targeting control) |
|---|---|---|---|---|
| 413 | | GGCAGATGAGAAGGCACAGA | 59.89738685 | 59.5785052 |
| 415 | | ACACGGTCCGGCAGATGAGA | 41.29188182 | 52.515655 |
| 412 | | GTCTGTGCCTTCTCATCTGC | 70.71073836 | 72.0049046 |
| 416 | | GAAGCGAAGTGCACACGGTC | 31.51588976 | 59.2847924 |
| 417 | | GAGGTGAAGCGAAGTGCACA | 53.23795933 | 54.7085711 |
| 419 | | GGTCTCCATGCGACGTGCAG | 98.80315853 | 94.871871 |
| 418 | | CTTCACCTCTGCACGTCGCA | 76.66072308 | 76.4195077 |
| 421 | | GTCCTCTTATGTAAGACCTT | 50.06169791 | 63.8903663 |
| 422 | | AGTCCTCTTATGTAAGACCT | 54.84793515 | 62.0058784 |
| 420 | | TGCCCAAGGTCTTACATAAG | 65.64906417 | 79.7359246 |
| 423 | | GTCTTACATAAGAGGACTCT | 65.0201597 | 62.5458243 |
| 424 | | AATGTCAACGACCGACCTTG | 53.64938718 | 65.5805852 |
| 425 | | TTTGAAGTATGCCTCAAGGT | 68.9199506 | 80.763234 |
| 426 | gRNA#012 | AGTCTTTGAAGTATGCCTCA | 30.45840615 | 47.6679105 |
| 427 | | AAGACTGTTTGTTTAAAGAC | 75.19137394 | 74.1370789 |
| 428 | | AGACTGTTTGTTTAAAGACT | 66.21290133 | 75.2309845 |
| 429 | | CTGTTTGTTTAAAGACTGGG | 63.52924235 | 72.0972239 |
| 430 | | GTTTAAAGACTGGGAGGAGT | 52.01423199 | 66.8961386 |
| 431 | | TCTTTGTACTAGGAGGCTGT | 51.48581844 | 68.9533809 |
| 432 | | AGGAGGCTGTAGGCATAAAT | 37.69681736 | 56.2655965 |
| 433 | | GTGAAAAGTTGCATGGTGC | 82.88524703 | 98.0043703 |
| 434 | | GCAGAGGTGAAAAGTTGCA | 31.73533955 | 53.6210823 |
| 435 | gRNA#013 | AACAAGAGATGATTAGGCAG | 30.51551968 | 43.8402184 |
| 436 | gRNA#014 | GACATGAACAAGAGATGATT | 15.37394867 | 25.9017005 |
| 437 | | AGCTTGGAGGCTTGAACAGT | 84.06388656 | 100.433196 |
| 441 | gRNA#015 | CCACCCAAGGCACAGCTTGG | 22.57628478 | 29.4502561 |
| 443 | | AAGCCACCCAAGGCACAGCT | 38.69686132 | 57.447646 |
| 438 | | CAAGCCTCCAAGCTGTGCCT | 57.03790348 | 55.3144232 |
| 439 | | AAGCCTCCAAGCTGTGCCTT | 101.2197916 | 108.433992 |
| 442 | | AGCTGTGCCTTGGGTGGCTT | 62.50798441 | 75.5245296 |
| 444 | | GCTGTGCCTTGGGTGGCTTT | 63.60985011 | 68.2127614 |
| 445 | | CTGTGCCTTGGGTGGCTTTG | 58.80930094 | 60.2093595 |
| 446 | | TAGCTCCAAATTCTTTATAA | 81.50792369 | 102.062484 |
| 447 | | GTAGCTCCAAATTCTTTATA | 57.5300482 | 84.4089935 |
| 448 | | TAAAGAATTTGGAGCTACTG | 55.34840957 | 67.1682598 |
| 449 | | ATGACTCTAGCTACCTGGGT | 70.72899714 | 69.314819 |

TABLE 13-continued

Exemplary target domain sequences and effect on HbeAg and HbsAg expression guide RNA

| SEQ IDs | Associated guide RNA name (if applicable) | Target domain sequence | HbeAg (%expression of non targeting control) | HbsAg (%expression of non targeting control) |
|---|---|---|---|---|
| 450 | | CACATTTCTTGTCTCACTTT | 135.7647935 | 119.430868 |
| 451 | | TAGTTTCCGGAAGTGTTGAT | 52.38647155 | 59.8621336 |
| 452 | | CGTCTAACAACAGTAGTTTC | 84.81350809 | 79.1119745 |
| 453 | | ACTACTGTTGTTAGACGACG | 50.34753433 | 57.5139945 |
| 454 | | CTGTTGTTAGACGACGAGGC | 47.03375963 | 53.0434947 |
| 455 | | CGAGGGAGTTCTTCTTCTAG | 36.81318989 | 50.1844755 |
| 456 | | GCGAGGGAGTTCTTCTTCTA | 68.04429109 | 71.2738682 |
| 457 | gRNA#016 | GGCGAGGGAGTTCTTCTTCT | 35.40374342 | 49.4263836 |
| 459 | | GACCTTCGTCTGCGAGGCGA | 28.35732375 | 53.108582 |
| 460 | | AGACCTTCGTCTGCGAGGCG | 41.45363172 | 58.2048965 |
| 461 | | GATTGAGACCTTCGTCTGCG | 63.13599738 | 73.3793991 |
| 458 | | CTCCCTCGCCTCGCAGACGA | 41.73812486 | 56.4066766 |
| 462 | | GATTGAGATCTTCTGCGACG | 134.1434937 | 133.039909 |
| 463 | | GTCGCAGAAGATCTCAATCT | 44.87633493 | 58.0732445 |
| 464 | | TCGCAGAAGATCTCAATCTC | 70.59684886 | 75.0458487 |
| 465 | gRNA#017 | ATATGGTGACCCACAAAATG | 41.36374656 | 46.043276 |
| 466 | | TTTGTGGGTCACCATATTCT | 66.33644682 | 65.6466534 |
| 467 | gRNA#018 | TTGTGGGTCACCATATTCTT | 48.06595023 | 41.7714626 |
| 468 | | GCTGGATCCAACTGGTGGTC | 65.83430344 | 69.3357339 |
| 469 | | CACCCCAAAAGGCCTCCGTG | 21.63462413 | 23.5507547 |
| 471 | gRNA#019 | CCTGAGGGCTCCACCCCAAA | 45.40727826 | 44.6869573 |
| 470 | | CCTTTTGGGGTGGAGCCCTC | 50.06807456 | 31.73417 |
| 472 | | GGGGTGGAGCCCTCAGGCTC | 64.29444481 | 64.1755302 |
| 473 | | GGGTGGAGCCCTCAGGCTCA | 44.19826805 | 53.1051257 |
| 474 | | CGATTGGTGGAGGCAGGAGG | 65.52555289 | 60.9306557 |
| 475 | gRNA#020 | CTCATCCTCAGGCCATGCAG | 35.40063237 | 17.5286587 |

Figure 5A:
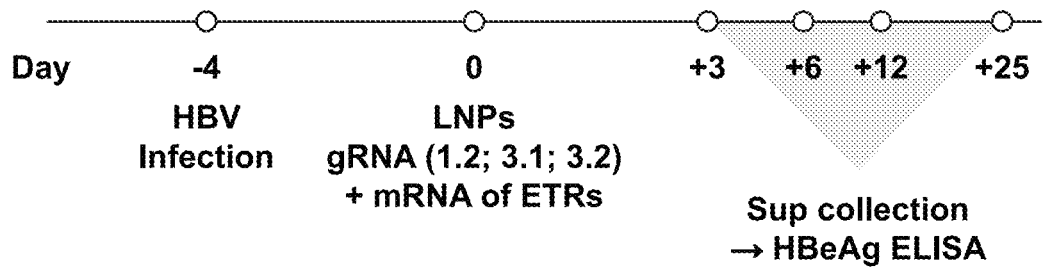
FIG. 5A is a diagram describing the experimental timeline for testing different CRISPR-based epigenetic repressors in a HepG2-NTCP infection model (see, e.g., Methods Mol Biol. 2017; 1540:1-14).
Figure 5B:
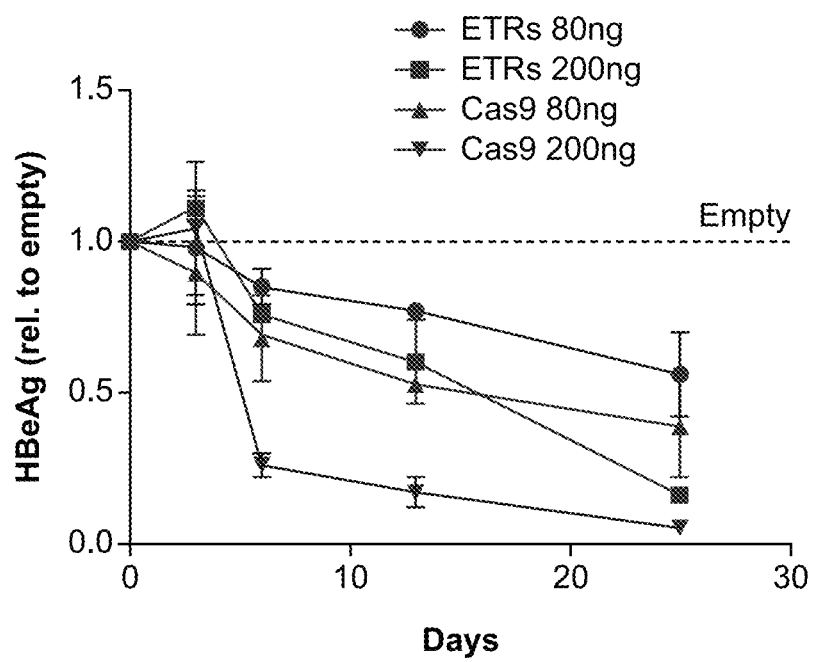
FIG. 5B is a diagram showing the expression of HBe antigen (via ELISA) at different times after treatment of HBV-infected Hep2G-NTCT cells with different doses of CRISPR-based epigenetic repressors (ETRs), or with different doses of Cas9 nuclease targeting HBV (Cas9), plotted normalized to the expression value of HBe antigen measured for a negative control (empty).
Figure 6:
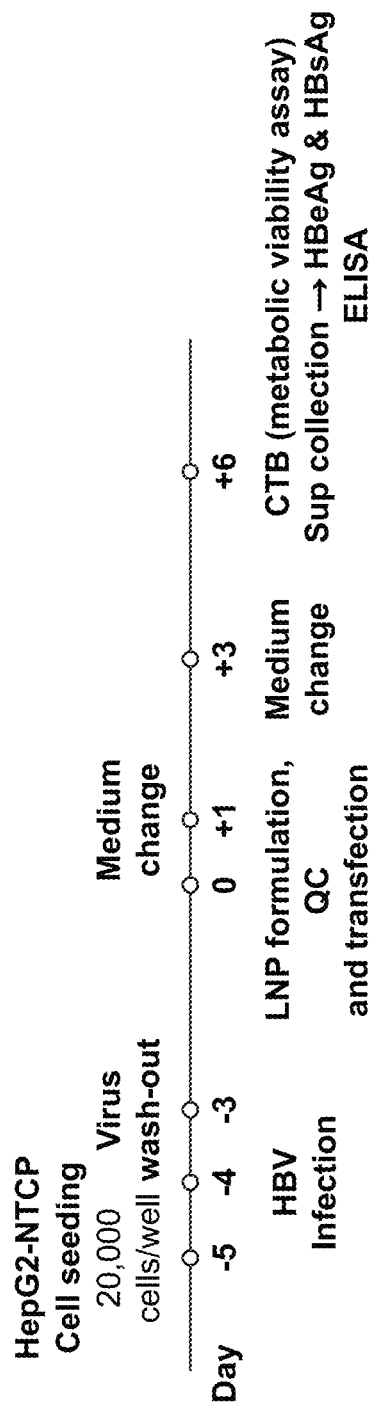
FIG. 6 is a diagram describing the experimental timeline for a guide RNA screen testing different CRISPR-based epigenetic repressor systems in a HepG2-NTCP infection model with ELISA readout for HBe and HBs antigens at day 6.
Figure 7:
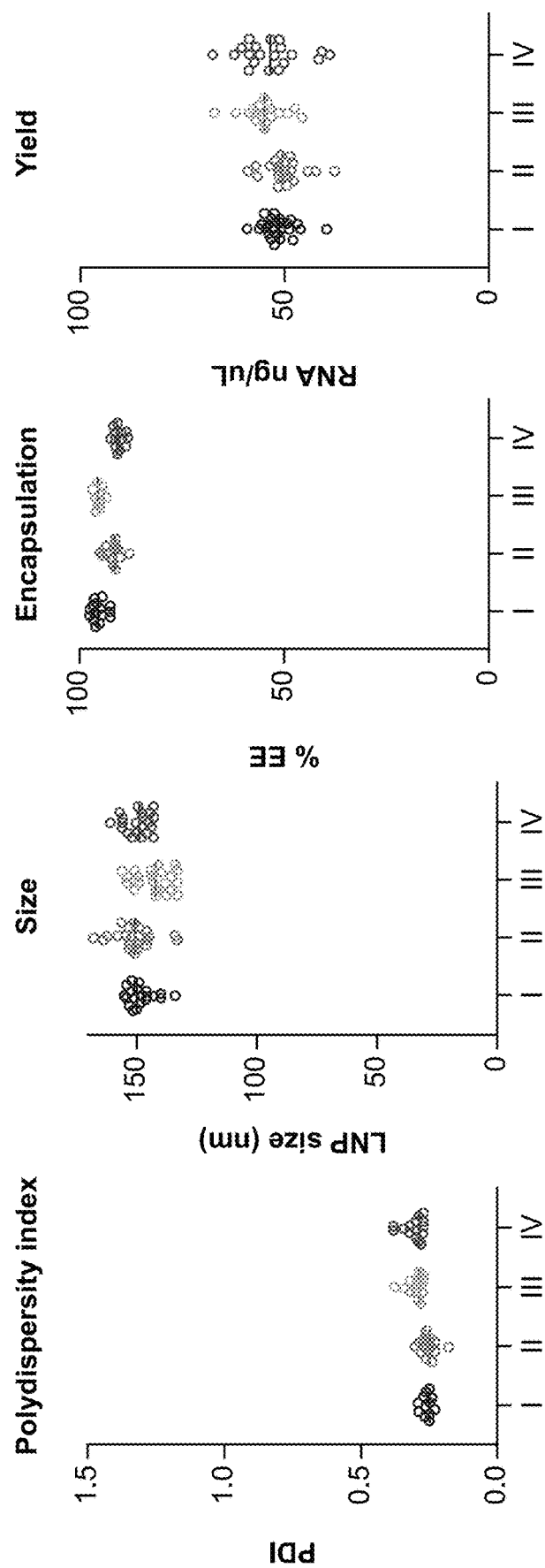
FIG. 7 is a diagram showing QC results from different LNP batches used in the guide screen.
Figure 8:
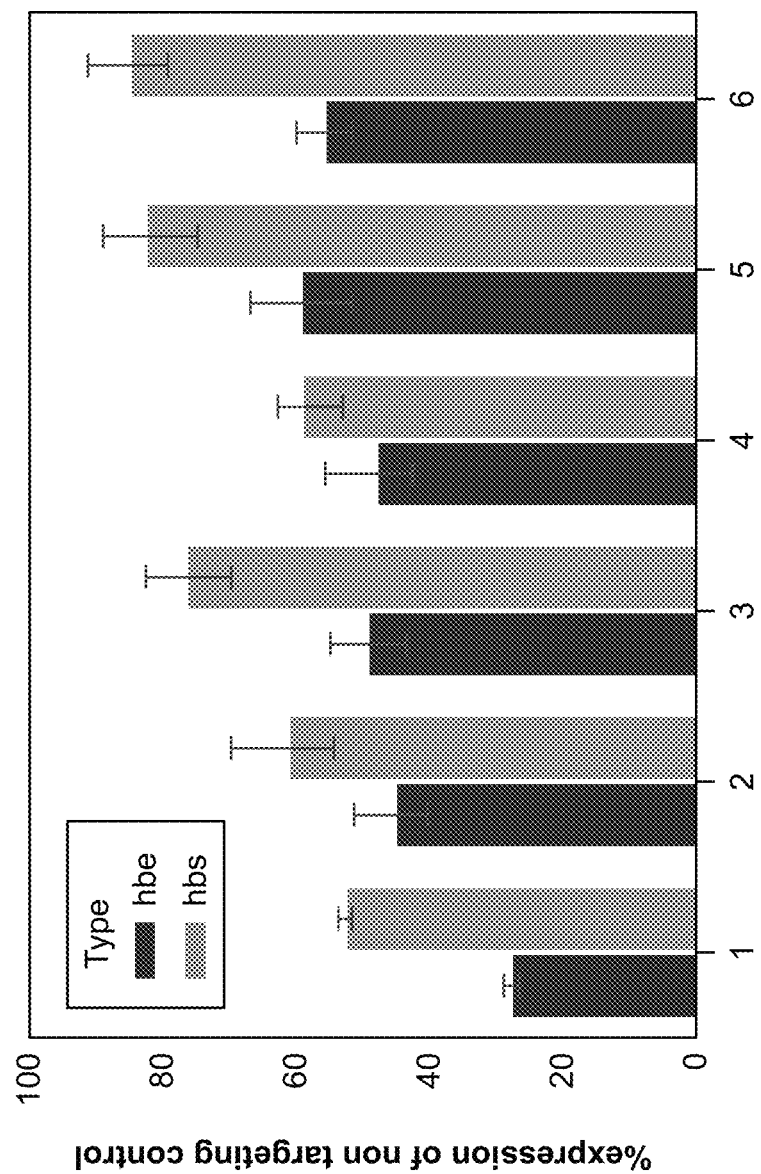
FIG. 8 is a bar graph showing the expression of HBe and HBs for an exemplary CRISPR-based epigenetic repressor (#3.2), calculated as the percentage of the expression of the respective antigen measured for a non-targeting control.
Figure 9:
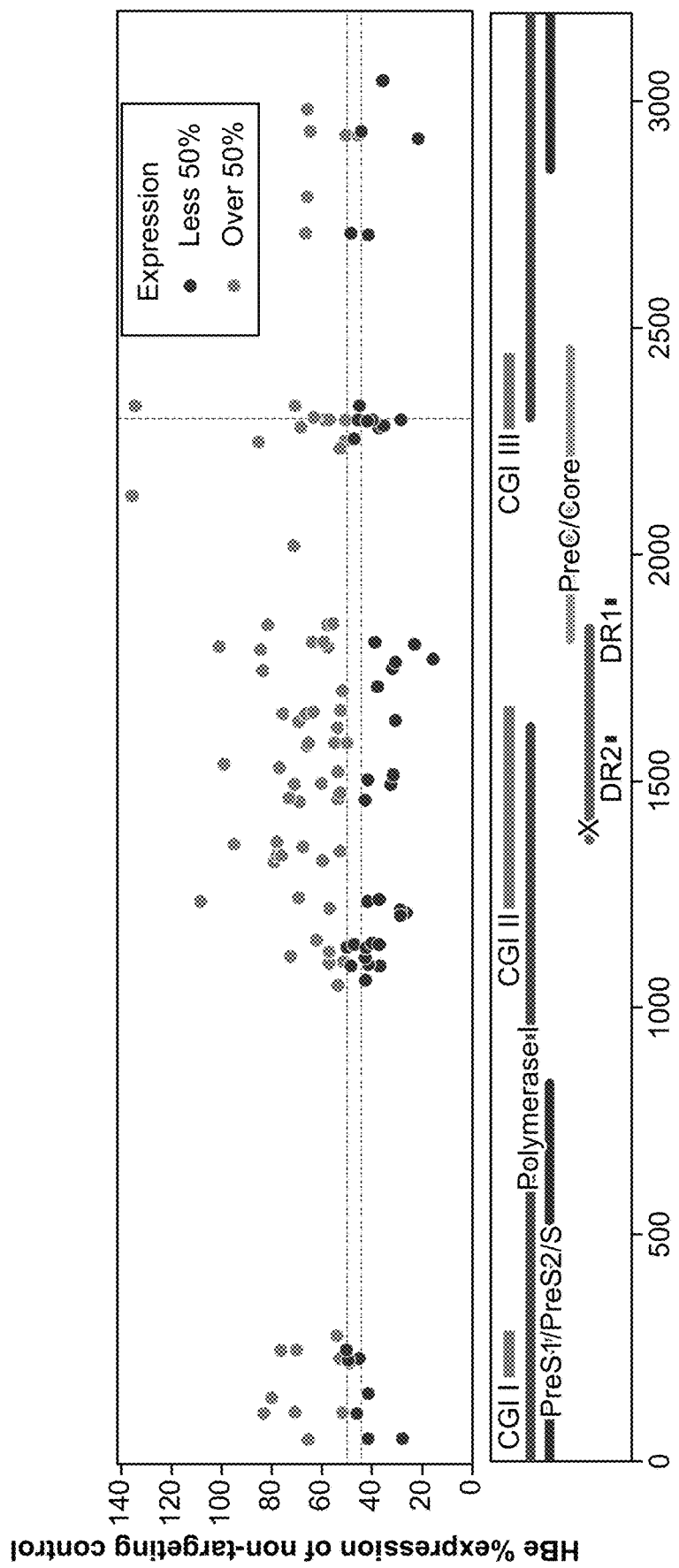
FIG. 9 is a diagram showing HBe expression values measured in the guide RNA screen for different guides (calculated as a percentage of the expression of HBe measured for a non-targeting control). Each guide/repressor combination is represented by a dot. A 50% repression cutoff is shown as a horizontal line. The position of the respective guide RNA within the HBV genome (shown at the bottom of the graph) is mapped on the X-axis. The position and the measured modulation of HBe expression for exemplary guide RNA #3.2 is indicated by red lines.
Figure 10:
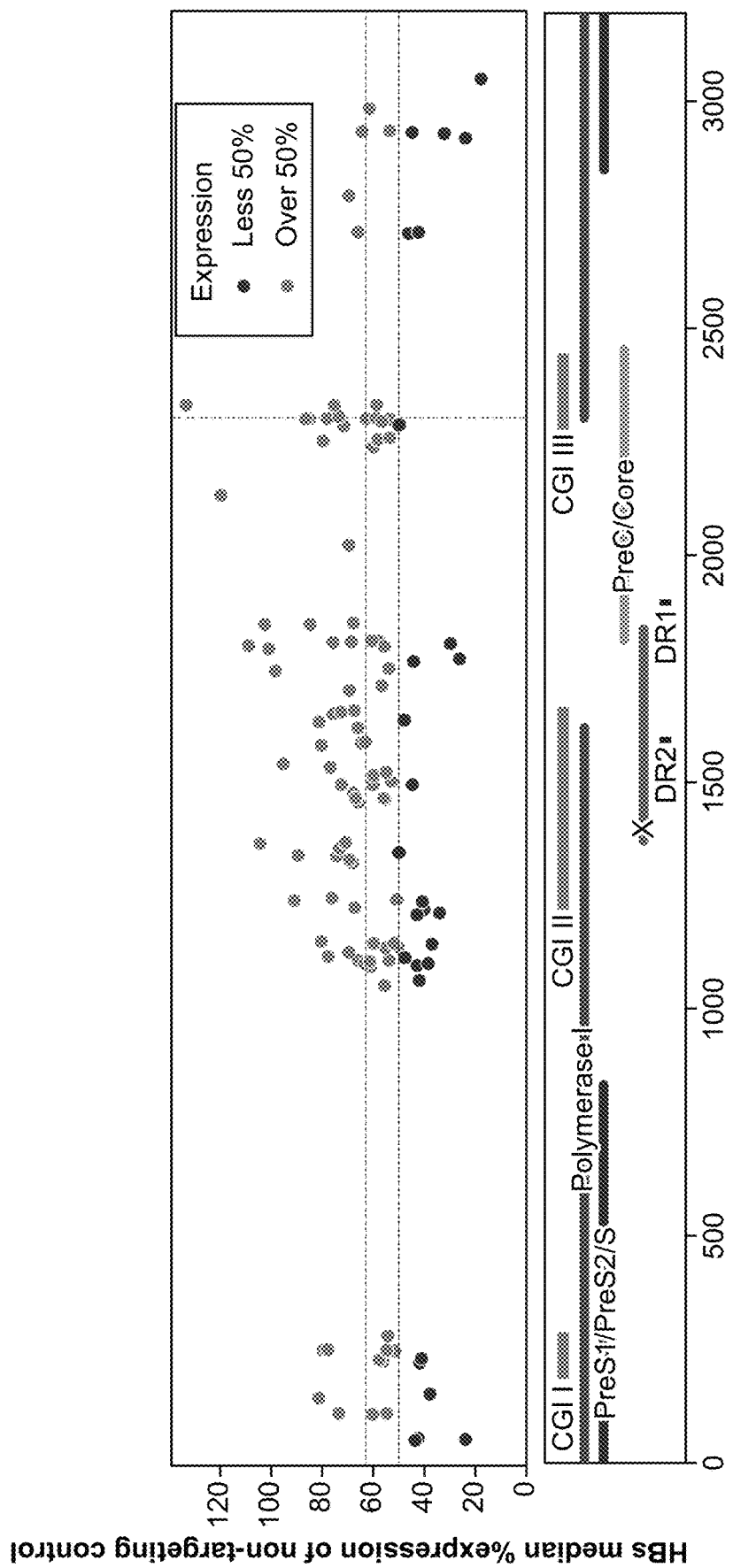
FIG. 10 is a diagram showing HBs expression values measured in the guide RNA screen for different guides (calculated as a percentage of the expression of HBs measured for a non-targeting control). Each guide/repressor combination is represented by a dot. A 50% repression cutoff is shown as a horizontal line. The position of the respective guide RNA within the HBV genome (shown at the bottom of the graph) is mapped on the X-axis. The position and the measured modulation of HBs expression for exemplary guide RNA #3.2 is indicated by red lines.
Figure 11:
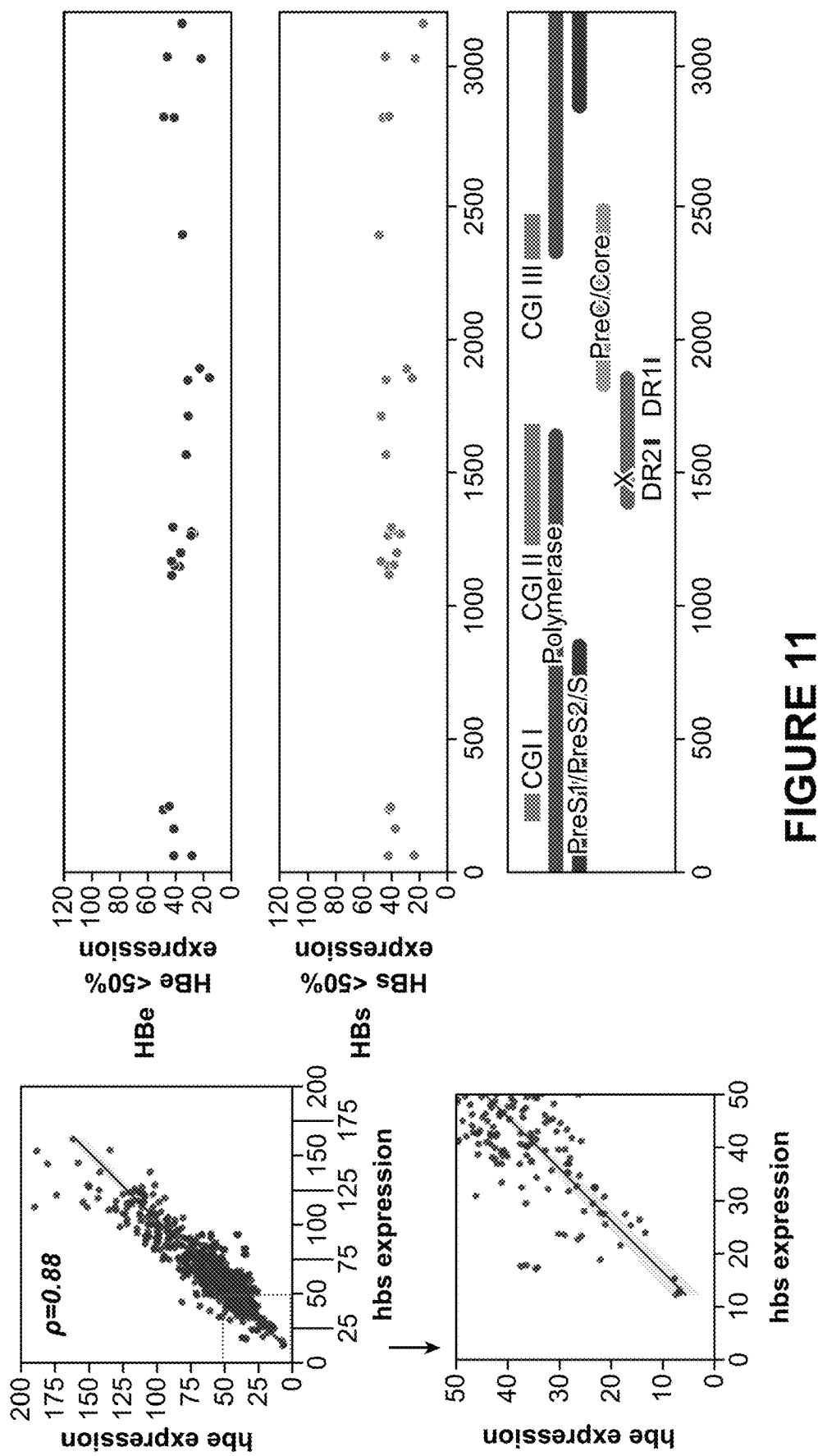
FIG. 11 is a diagram showing a correlation between HBs and HBe expression for the guides tested. The graph on the right shows HBe and HBs repression efficiencies for 25 exemplary guides.

In vitro silencing was observed in an HepG2-NTCP infection model with gRNAs targeting CpG islands with ETRs (FIG. 5A-FIG. 5B). A primary screen was conducted using LNPs of quality within expected parameters and a pilot experiment with a single guide (FIG. 6-FIG. 8). Results demonstrated that 48 gRNAs showed less than 50% expression of HBeAg at day 6 compared to non-targeting control (FIG. 9) and 28 gRNAs showed less than 50% expression of HBsAg at day 6 compared to non-targeting control (FIG. 10). HBsAg and HBeAg expression was positively correlated as shown in FIG. 11.

Example 4: Zinc Finger Repressors for Silencing HBV

Zinc finger repressors targeting epigenetic target sites identified in the HBV genome were designed. Table 1 above provides amino acid sequences of zinc finger and its corresponding motif sequences and target sequences of the zinc finger.

Zinc finger repressors described in Table 1 are tested in an HBV infection model, e.g., in HepG2 cells as described herein, and efficient repression of HBV is confirmed for the zinc finger repressors provided in Table 1.

Example 5: Further In Vitro Evaluation of gRNAs

A CRISPR-Off single construct encoding PLA002, consisting of KRAB, DNMT3A, DNMT3L, and dCas9, was used in combination with one or more of the designed sgRNAs for the in vitro assays described in this example.

Figure 12A:
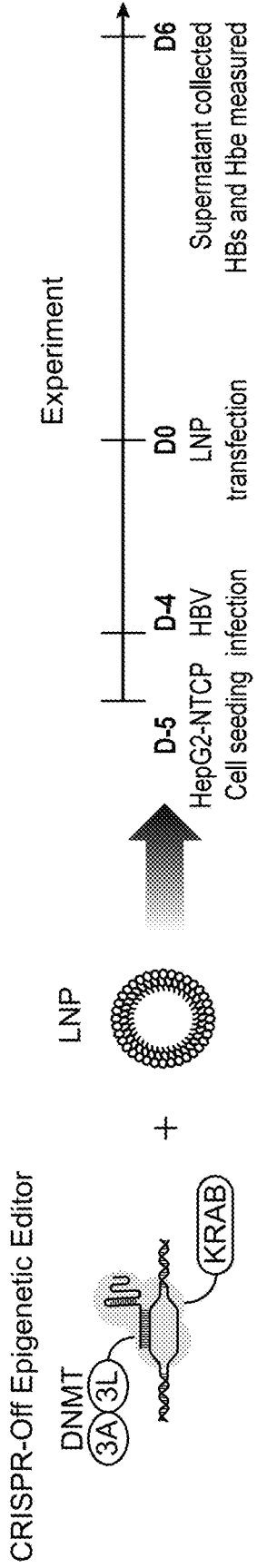
FIG. 12A is a diagram describing the experimental timeline for a guide RNA assay testing CRISPR-off single construct epigenetic editor in combination with individual exemplary gRNAs in a HepG2-NTCP infection model with ELISA readout for HBe and HBs antigens at day 6.
Figure 12B:
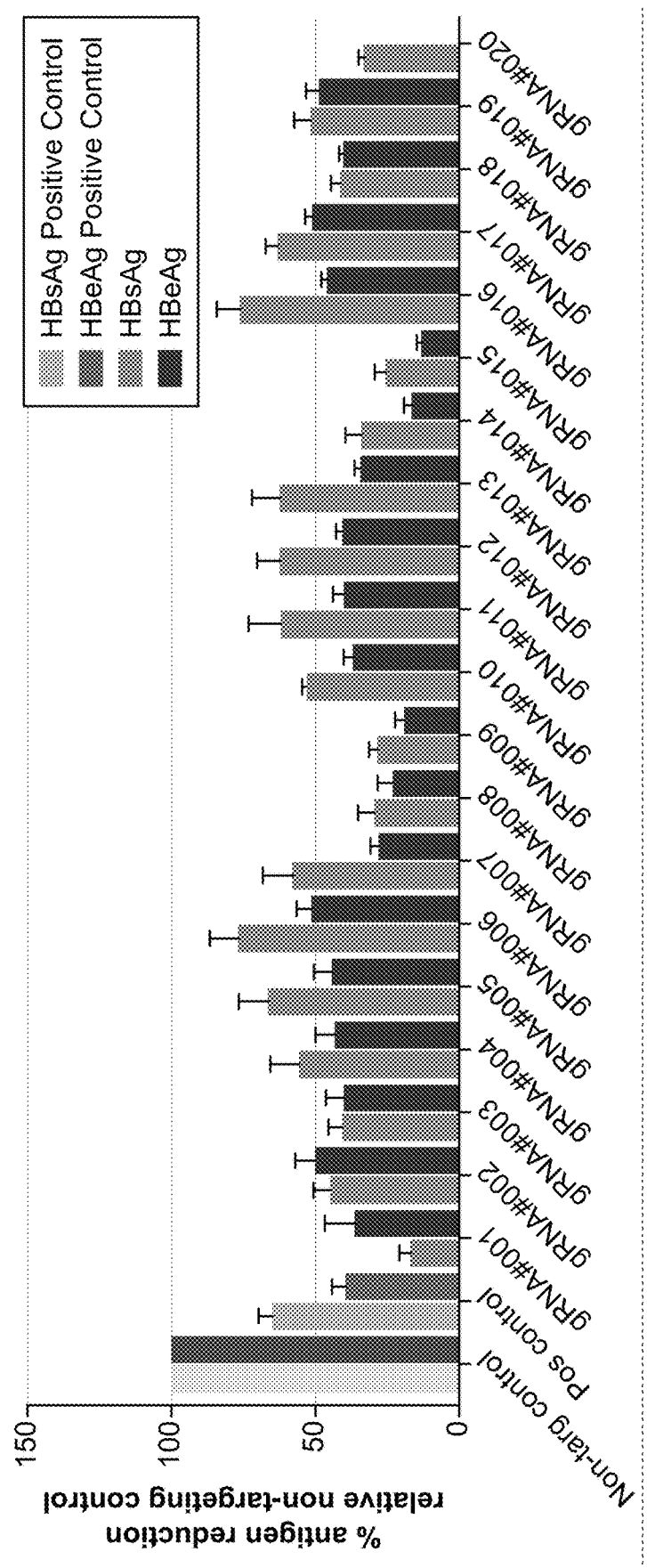
FIG. 12B is a graph summarizing the percentage reduction in HBV antigens at day 6 relative to non-targeting control.

HepG2-NTCP cells were infected with HBV for 4 days, following procedures similar as those in Example 3, and were then transfected with CRISPR-off construct and individual exemplary gRNAs (as indicated in Table 13) formulated in a research-grade LNP. At Day 6 post-transfection HBsAg and HBeAg protein expression in the supernatant was evaluated by ELISA, as depicted in FIG. 12A. Results from this experiment are shown in FIG. 12B. All of the tested gRNAs led to reduction of HBsAg and HBeAg levels in the supernatant. Positive control used in this experiment is a gRNA against HBV genome that was previously shown to reduce antigens ~50%.

Figure 13A:
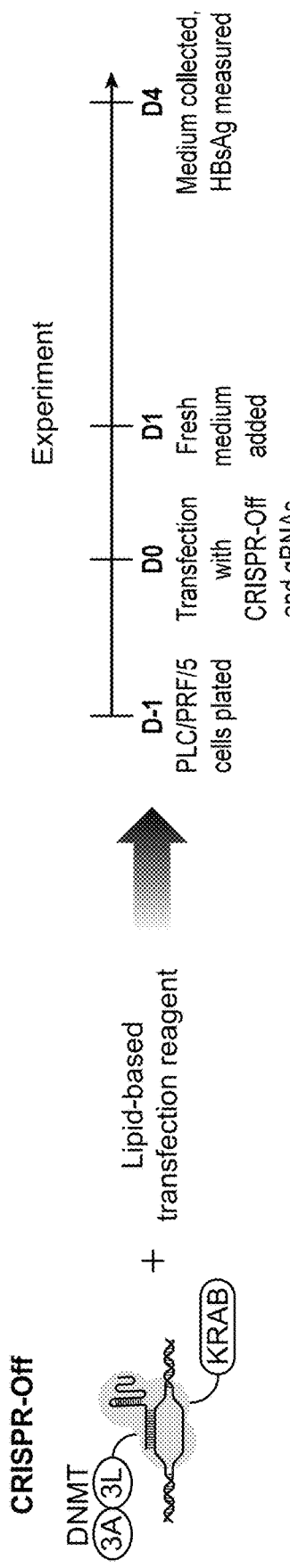
FIG. 13A is a diagram describing the experimental timeline for a guide RNA assay testing CRISPR-off single construct epigenetic editor in combination with individual exemplary gRNAs in a PLC/PRF/5 cell model with ELISA readout for HBs antigen at day 4.
Figure 13B:
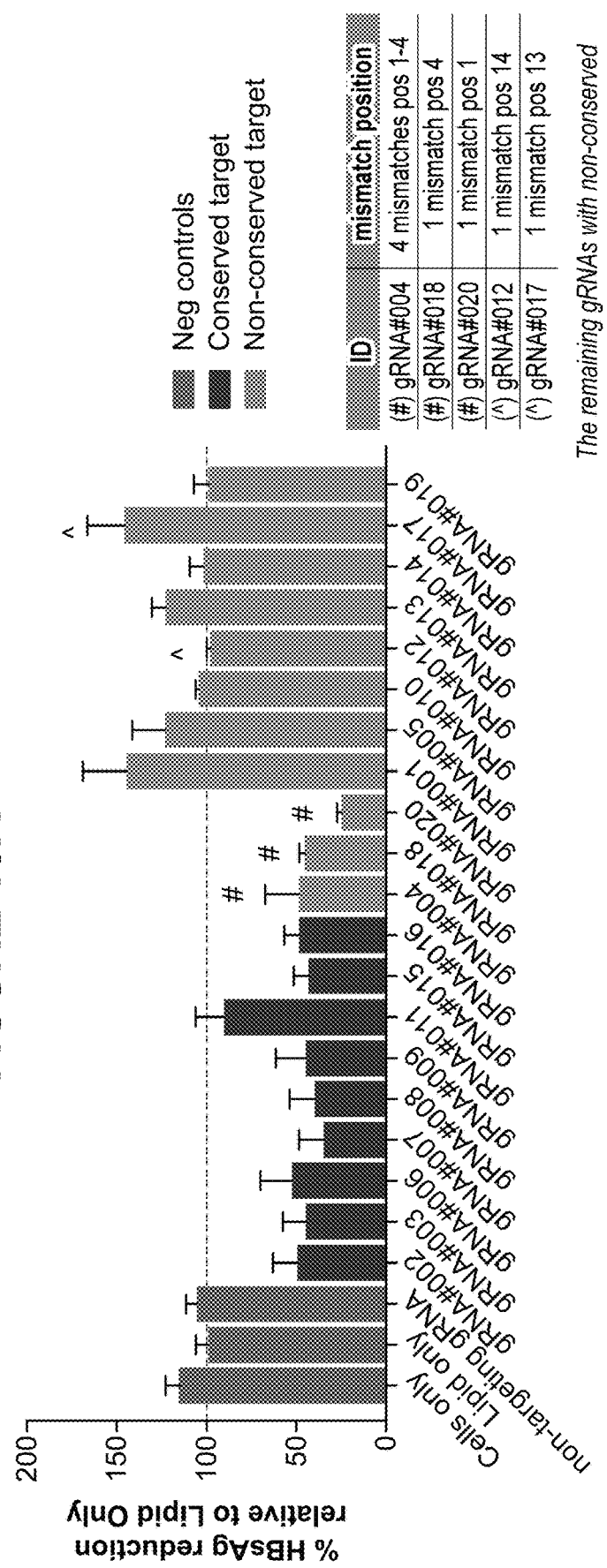
FIG. 13B is a graph summarizing the percentage reduction in HBs antigen at day 4 relative to non-targeting control.

In another experiment, the integrated HBV cell line, PLC/PRF/5, was used to evaluate activity of gRNAs. The PLC/PRF/5 cells were transfected with CRISPR-off (PLA002) and individual gRNAs using a commercial lipid-based transfection reagent. As depicted in FIG. 13A, four days after transfection HBsAg protein expression in the supernatant was evaluated by ELISA. Results from this experiment are shown in FIG. 13B. Target conservation was evaluated in silico and target conservation was defined as 100% gRNA-DNA match.

Figure 14C:
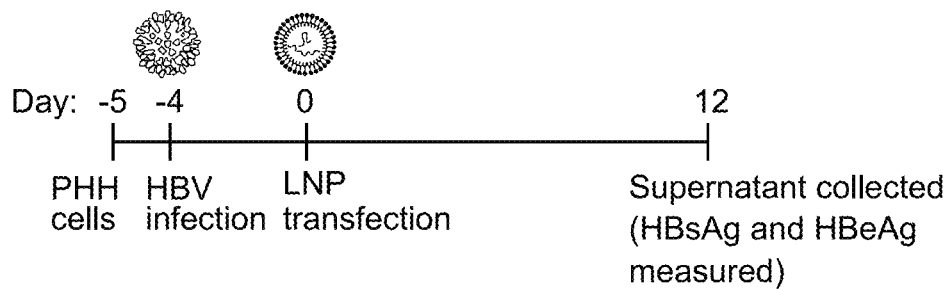
FIG. 14C is a diagram describing the experimental timeline for a guide RNA assay testing CRISPR-off single construct epigenetic editor in combination with individual exemplary gRNAs in a PXB cell model with ELISA readout for HBe and HBs antigens at day 12.
Figure 14D:
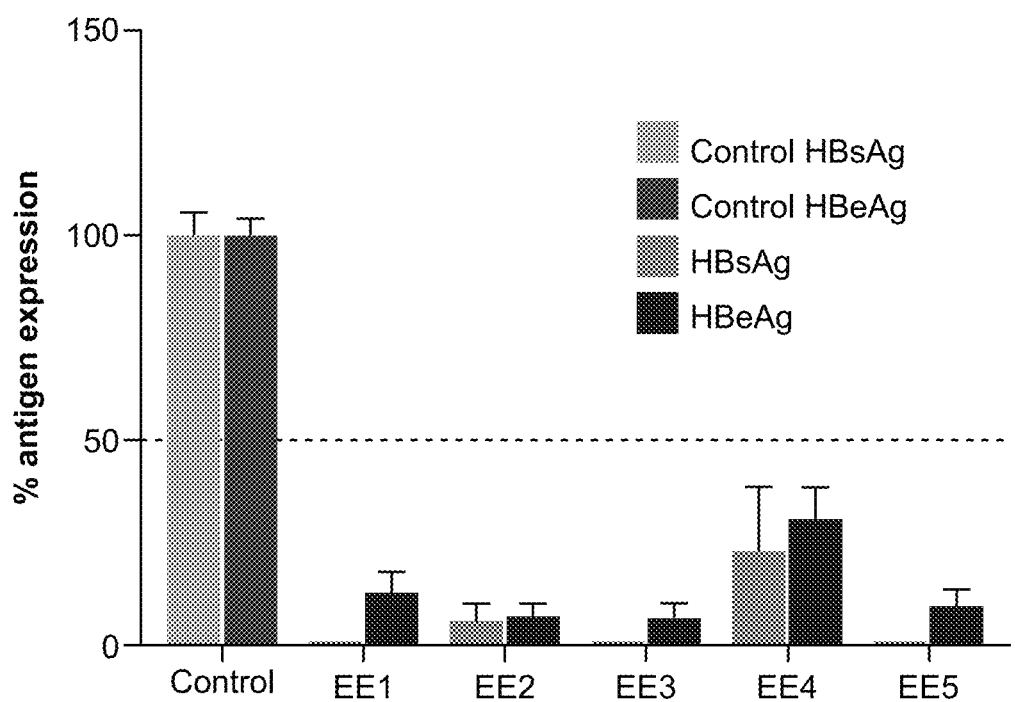
FIG. 14D is a graph summarizing the percentage reduction in HBV antigens at day 12 relative to non-targeting control. Bars represent mean±SEM; N=5. EE1=PLA002 and gRNA #007, EE2=PLA002 and gRNA #008, EE3=PLA002 and gRNA #009, EE4=PLA002 and gRNA #015, and EE5=PLA002 and gRNA #011.

In a further experiment, primary human hepatocytes (PHH) derived from humanized mice were infected with HBV for 4 days and then transfected with CRISPR-off (PLA002) and individual gRNAs formulated in a research-grade LNP, GenVoy LNPs. As depicted in FIG. 14A, at Day 6 post-infection HBsAg and HBeAg protein expression in the supernatant was evaluated by ELISA. Results from this experiment are shown in FIG. 14B. Positive control used in this experiment is an HBV gRNA that was previously shown to reduce antigens ~50%. The data suggested strong in vitro silencing by certain gRNAs at Day 6 after transfection. In a second PHH experiment, depicted in FIG. 14C, post-infection HBsAg and HBeAg protein expression in the supernatant was evaluated by ELISA at Day 12 after delivery of 100 ng of payload (1:1 effector to guide RNA ratio) in research-grade LNPs. Epigenetic editors repress HBsAg and HBeAg secretion in HBV infected PHH cells at this time point, as well. Results are shown in FIG. 14D. Sequences of the exemplary gRNAs that were tested in this example are listed in Table 13.

Example 6: In Vivo Silencing of HBV in HBV Rodent Models

Figure 15:
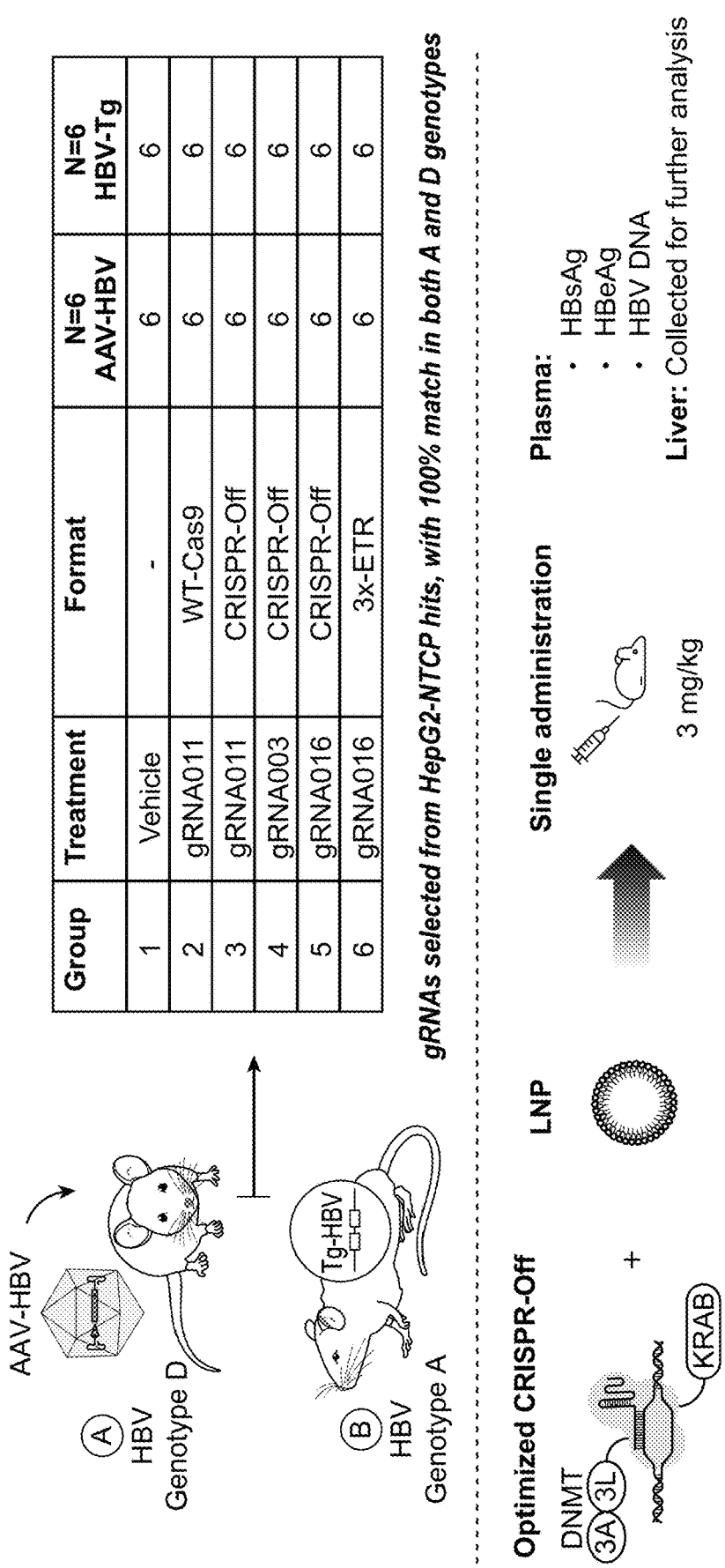
FIG. 15 is a diagram describing the design for in vivo experiments testing CRISPR-off single construct epigenetic editor in combination with individual exemplary gRNAs in AAV-HBV mouse HBV genotype D persistent infection model, and transgenic HBV genotype A mouse persistent infection model, respectively.

Two different HBV rodent models were tested in this study. As shown in FIG. 15, in one set of experiments, a non-transgenic model of persistent HBV infection in immunocompetent mice was used, which was established by administering an adeno-associated viral vector (AAV) that contains HBV Genotype D DNA into the mice. The administration of the AAV-HBV vector resulted in expression of hepatitis B surface antigen (HBsAg), hepatitis B e antigen (HBeAg), and high levels of serum HBV DNA in the mice. In another set of experiments, a transgenic mouse model of persistent HBV infection was used, whose genome was engineered to integrate HBV Genotype A DNA, resulting in expression of HBsAg and HBeAg, and circulating viral DNA in the mice.

Both mouse models were used to test 6 different treatment groups as shown in FIG. 15. At certain times (such as 7, 14, 28, and 35 days) after single administration of 3 mg/kg of the LNPs that were loaded with the CRISPR-off construct and respective gRNAs, WT-Cas9 construct and gRNA, or control vehicle, mouse serum was extracted for analysis of HBsAg, HBeAg, and HBV DNA. Later the mice were sacrificed, and their livers were collected for further analysis.

Figure 16:
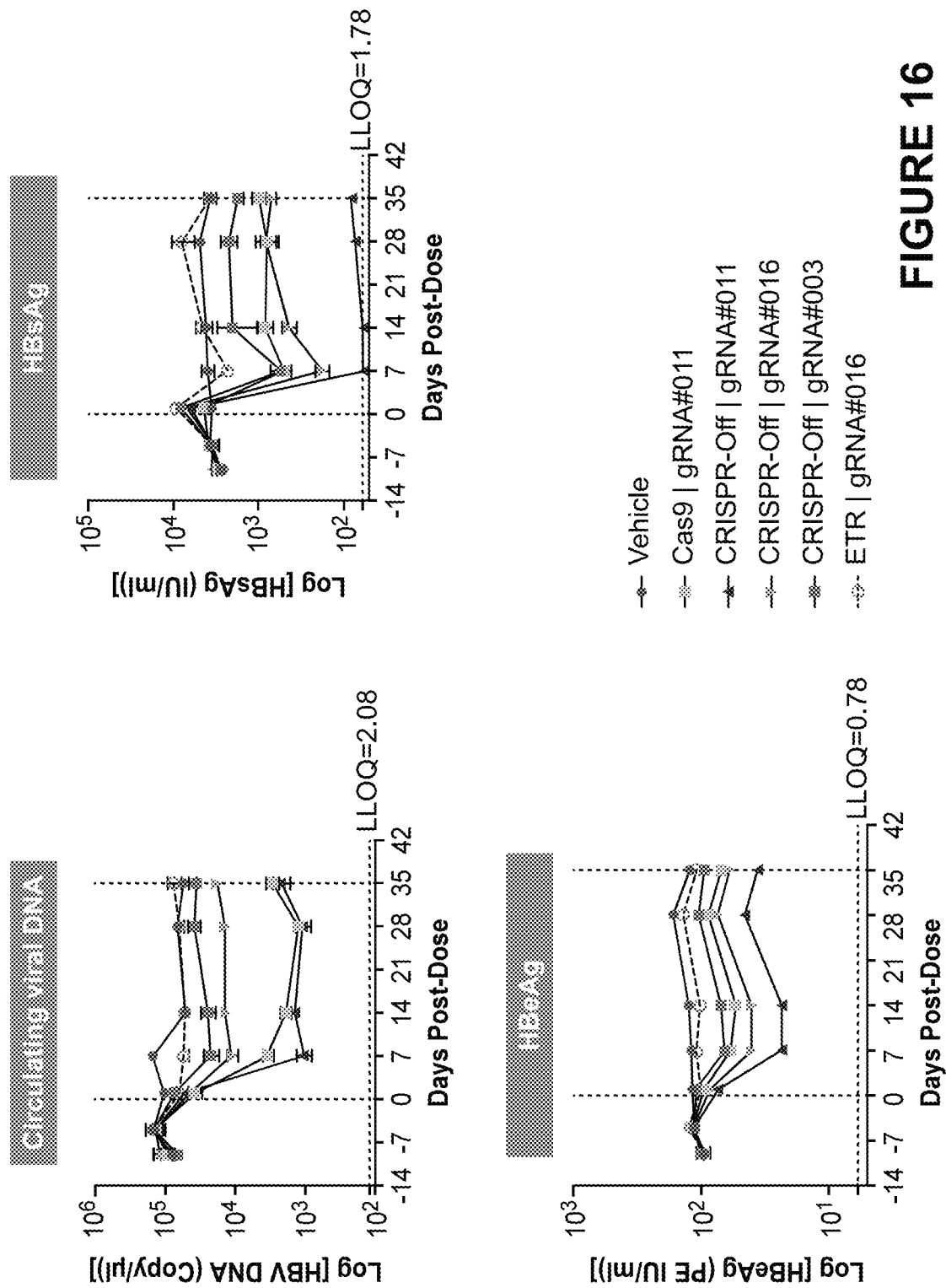
FIG. 16 shows time course graphs summarizing the level of serum HBV DNA, HBs and HBe antigens in transgenic mouse HBV model before and after single administration of an epigenetic editor (CRISPR-off with gRNA or ETR with gRNA), Cas9 with gRNA, or control vehicle at day 0.

As shown in FIG. 16, in transgenic mouse model, durable (~1 month) and efficacious (~2 Log) DNA and HBsAg reduction was observed with CRIPSR-Off/gRNA #011 treatment. And compared to Cas9 cutter, CRISPR-Off, when administered in combination with gRNA #011, showed similar circulating viral DNA reduction, but superior HBsAg and HBeAg reduction.

Figure 17:
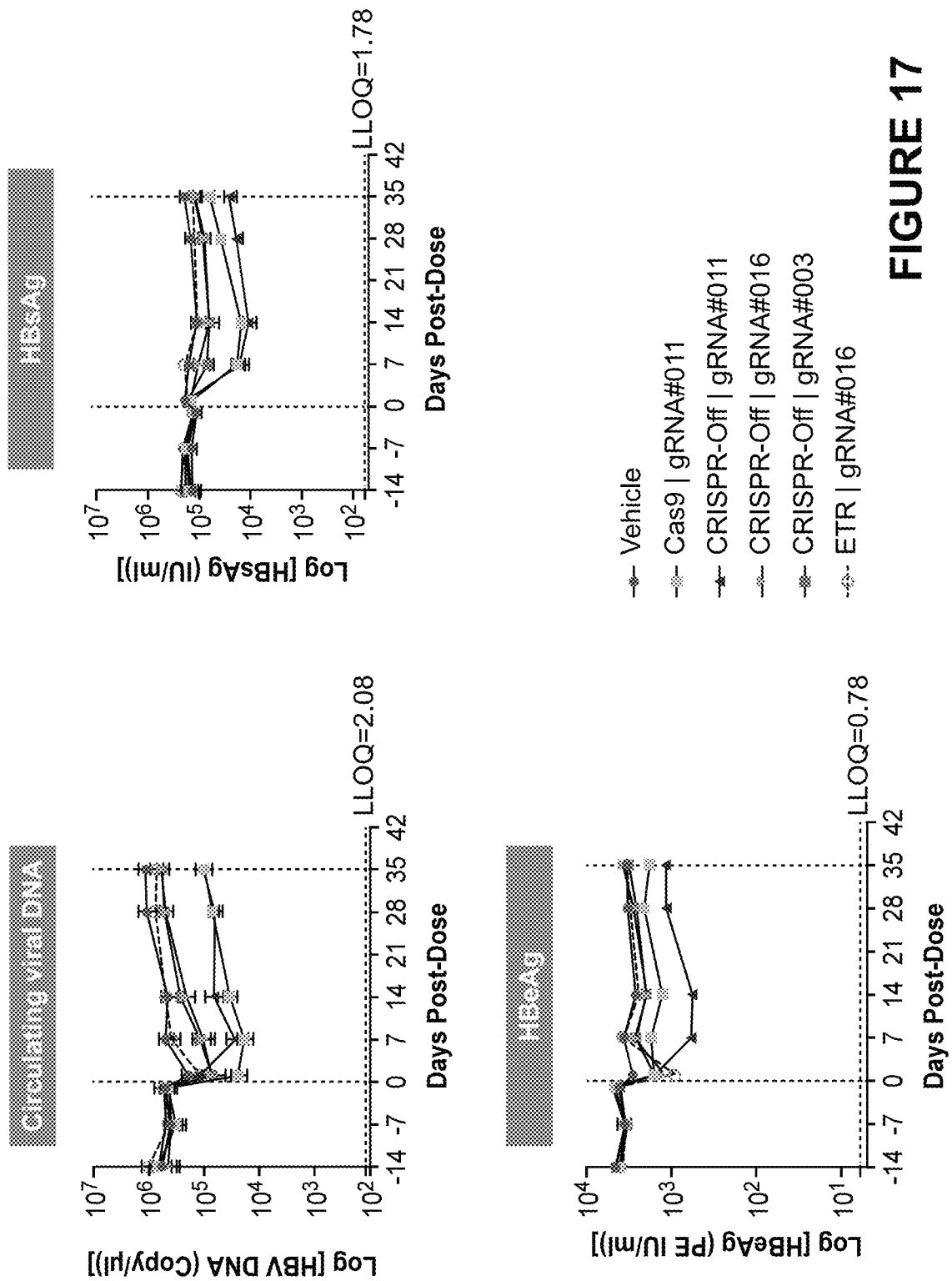
FIG. 17 shows time course graphs summarizing the level of serum HBV DNA, HBs and HBe antigens in AAV-HBV mouse model before and after single administration of an epigenetic editor (CRISPR-off with gRNA or ETR with gRNA), Cas9 with gRNA, or control vehicle at day 0.

Reduction of HBV markers in AAV-HBV model was also observed with administration of certain exemplary constructs. As shown in FIG. 17, overall results in AAV8-HBV model are similar to the Tg-HBV mouse model. About 1 log DNA and HBsAg antigen reduction was observed with administration of CRISPR-Off and gRNA #011.

Figure 18A:
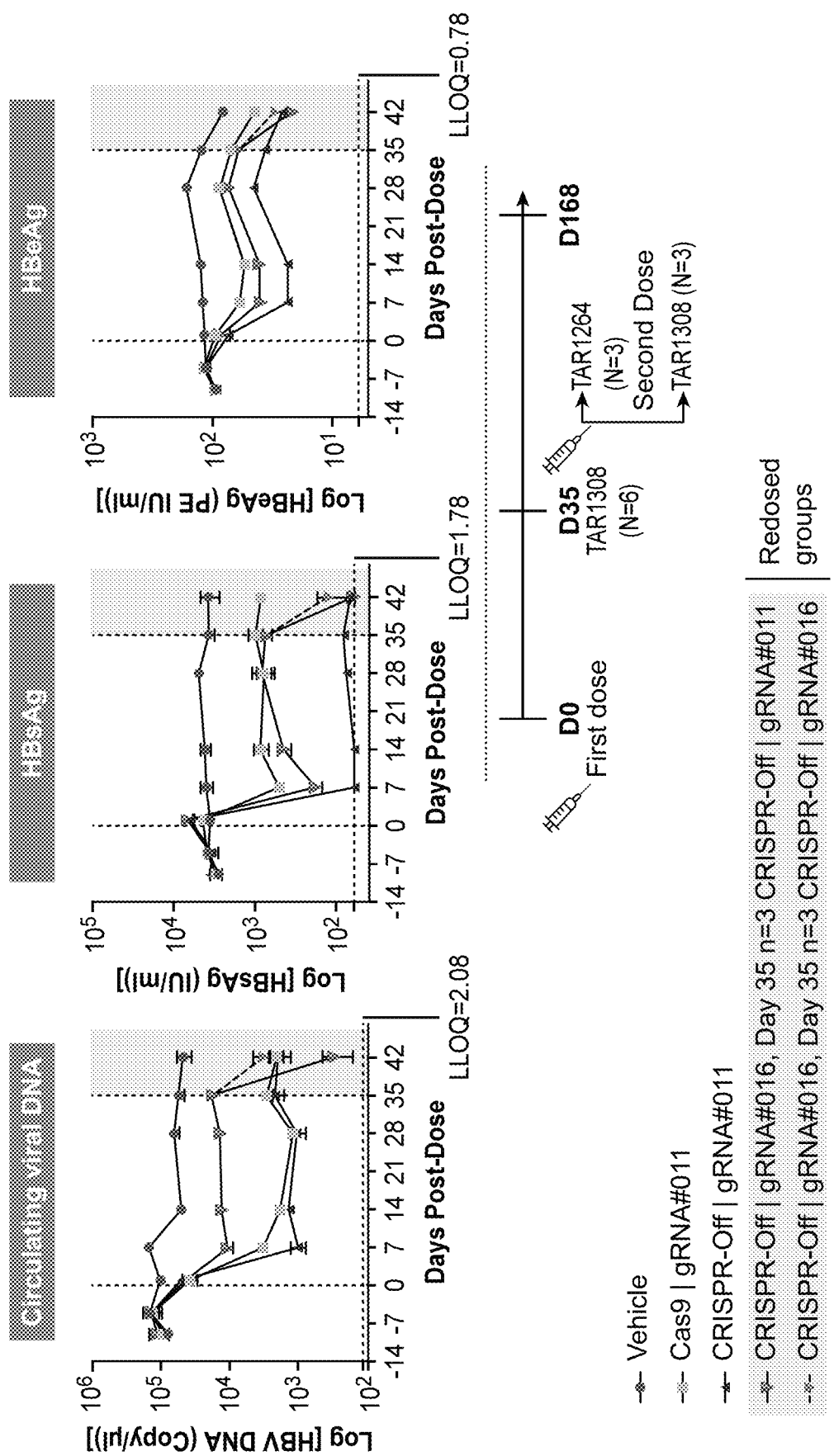
FIG. 18A shows time course graphs summarizing the level of serum HBV DNA, HBs and HBe antigens in transgenic mouse HBV model, and a schematic of the timeline for the experiment. All mice received a single administration of an epigenetic editor (CRISPR-off with gRNA or ETR with gRNA), Cas9 with gRNA, or control vehicle at day 0, and some mice received a designated redosing at day 35.

Effects of redosing of certain exemplary constructs were also tested. In the same experiments as above, among the six transgenic mice receiving administration of "CRISPR-off+ gRNA #016" (CRISPR-off construct and gRNA gRNA #016), three were administered with a dose of "CRISPR-off+ gRNA #016" on Day 35, and the other three were administered with "CRISPR-off+ gRNA #011" on Day 35. As shown in FIG. 18A, redosing either with a less effective gRNA (gRNA #016 in this case) or with a more effective gRNA (gRNA #011 in this case) enhanced the silencing of all HBV marker, as shown by reduction of circulating HBV DNA, HBsAg, and HBeAg on Day 42. Redosing the gRNA #016-treated group with gRNA #011 (more effective gRNA) resulted in a more substantial reduction than redosing with gRNA #016 (less effective gRNA).

Figure 18B:
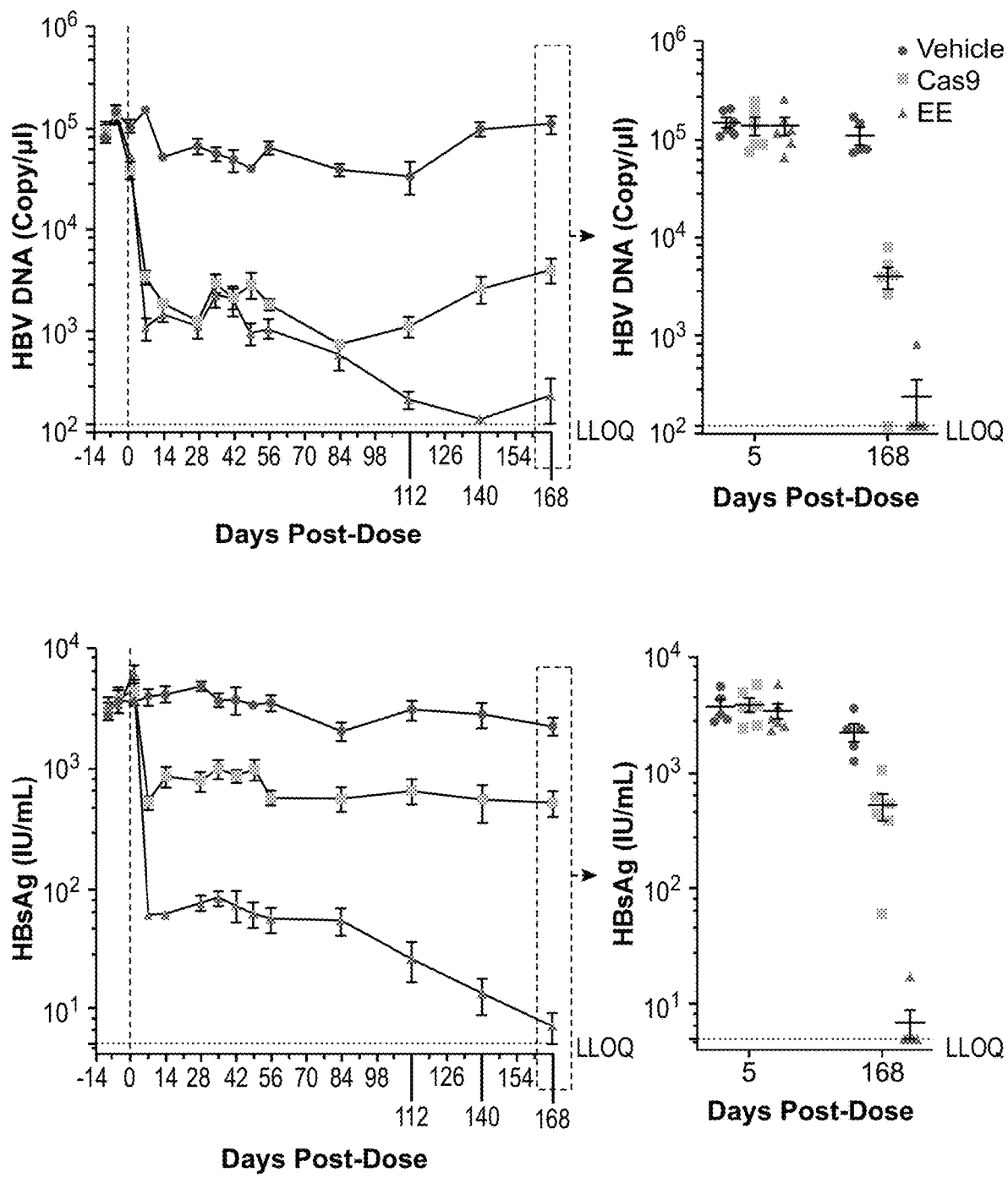
FIG. 18B shows results for the single-administration (no redosing) groups and controls to 168 days duration for HBV DNA and HBsAg. The lefthand panels shows the group data at each timepoint, whereas the right-hand panels show the readouts for individual animals at two timepoints. EE=epigenetic editor (CRISPR-off with gRNA #011).

Single-dose experiments were continued to 168 days, as shown in FIG. 18B. Results show durable and progressive reduction of viral antigens achieving −2.7 log DNA and −2.8 log HBsAg more than five months after single administration of an epigenetic editor (CRISPR-off with gRNA #011).

Five out of six animals tested had undetectable HBV DNA and HBsAg 168 days after a single dose of an epigenetic editor.

Figure 19:
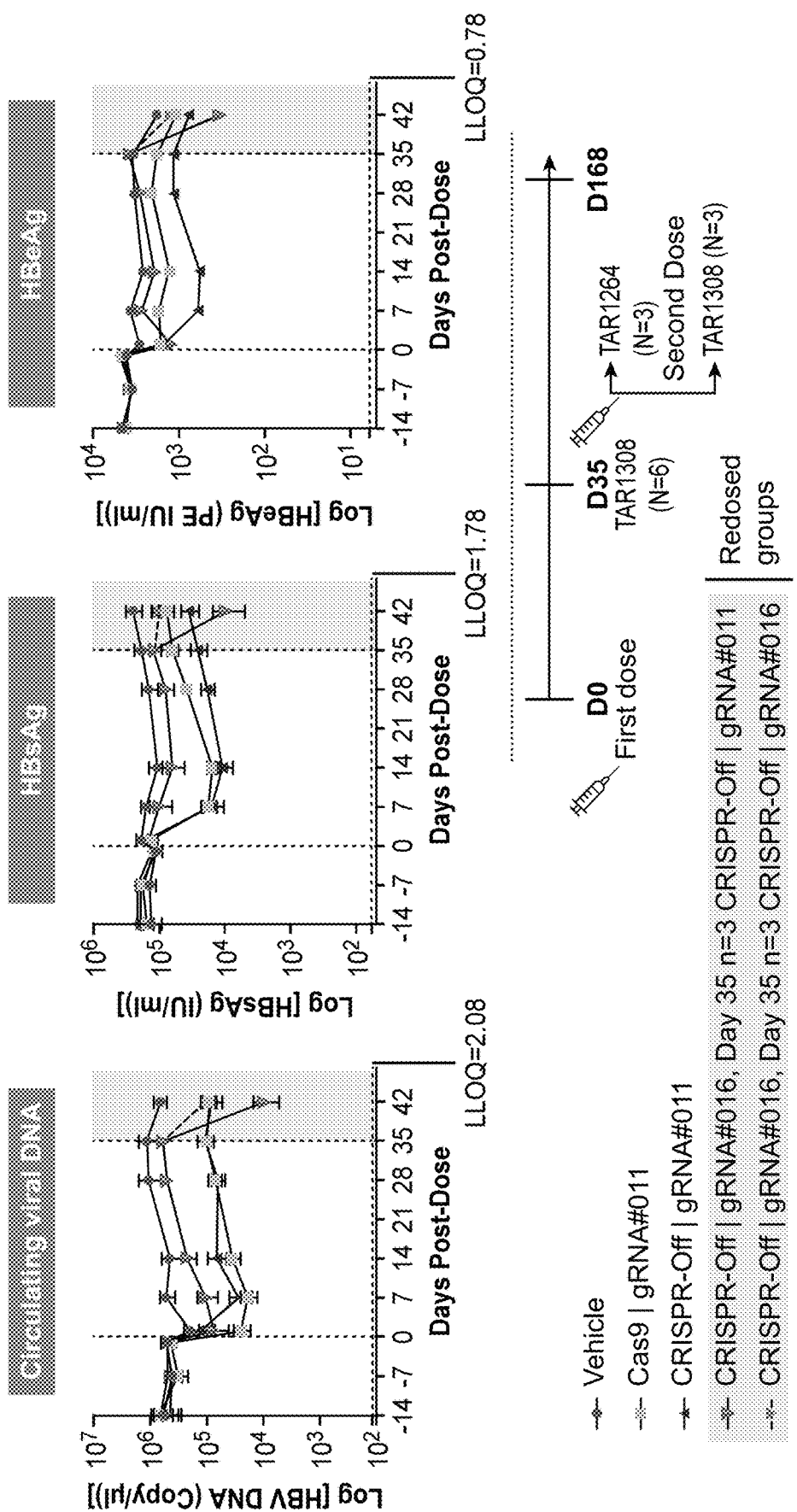
FIG. 19 shows time course graphs summarizing the level of serum HBV DNA, HBs and HBe antigens in AAV-HBV mouse model, and a schematic of the timeline for the experiment. All mice received a single administration of an epigenetic editor (CRISPR-off with gRNA or ETR with gRNA), Cas9 with gRNA, or control vehicle at day 0, and some mice received a designated redosing at day 35.

Redosing experiments were also conducted in AAV-HBV mouse model, as shown in FIG. 19. Dosing with two different gRNAs (gRNA #016 and gRNA #011) further decreased all HBV markers. These data suggest of a potential enhanced activity when two HBV regions are targeted.

Sequences of the exemplary gRNAs that were tested in this example are listed in Table 13.

Example 7: Evaluation of ZFP in HepG2-NTCP Cells

In this example, ZF-off single constructs encoding a fusion protein consisting of KRAB, DNMT3A, DNMT3L, and an exemplary zinc finger motif of choice, were tested. Sequences of the exemplary zinc fingers that were tested in this example are listed in Table 18, as are sequences for plasmids yielding a subset of the ZF-off single construct fusion proteins.

Figure 20A:
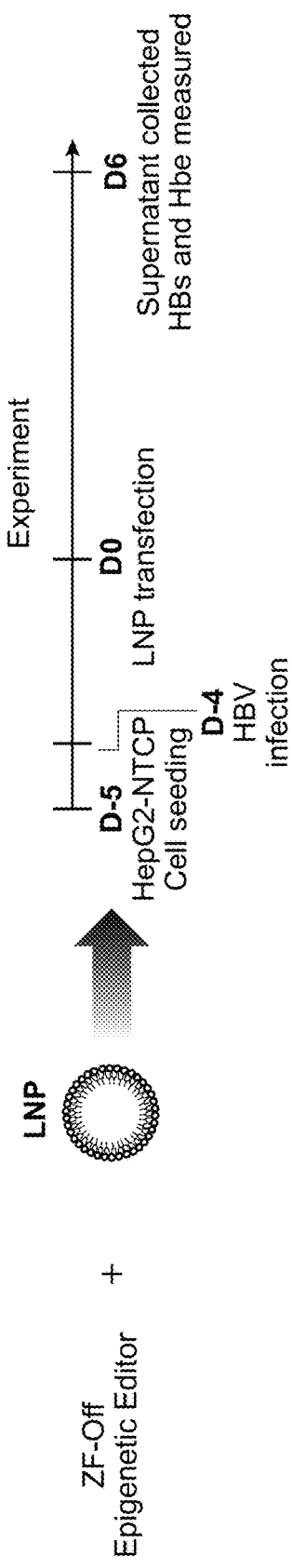
FIG. 20A is a diagram describing the experimental timeline for a zinc finger assay testing ZF-off single construct epigenetic editor that contains individual exemplary zinc finger motif in a HepG2-NTCP infection model with ELISA readout for HBe and HBs antigens at day 6.
Figure 20B:
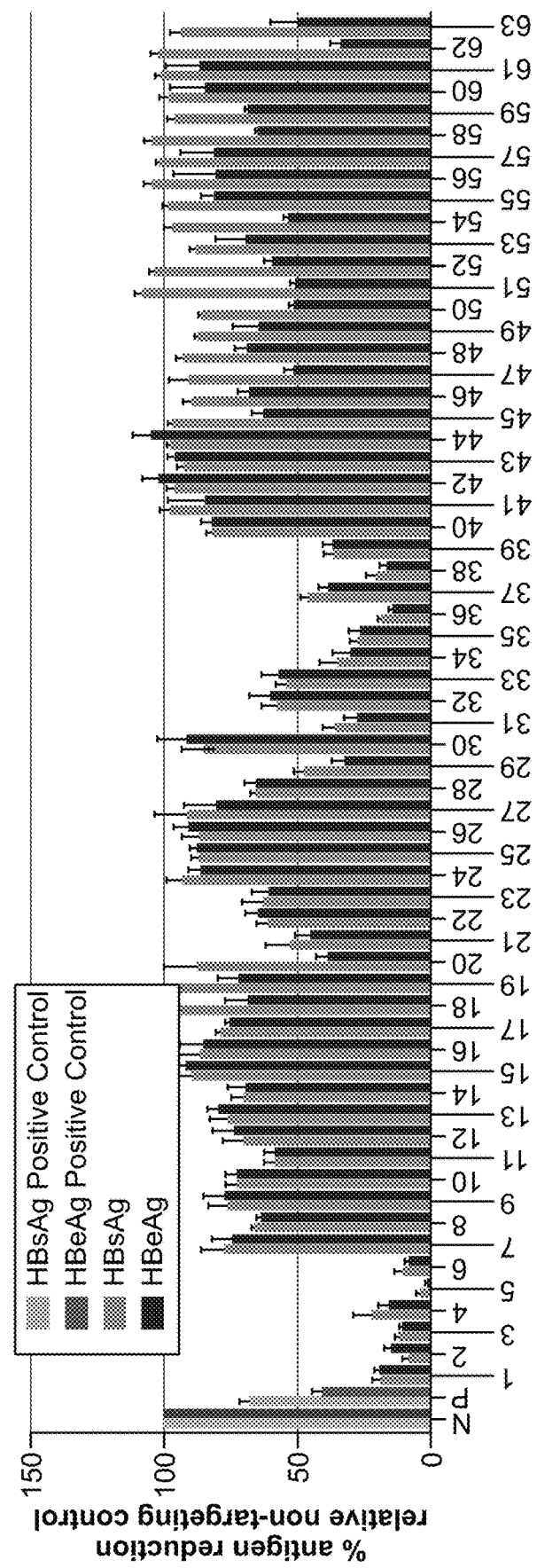
FIG. 20B is a graph summarizing the percentage reduction in HBV antigens at day 6 relative to non-targeting control. "N" denotes non-targeting control, "P" denotes the positive control, and the individual numbers on the x-axis denote exemplary constructs tested in the experiment, for instance, "1" represents "mRNA0001" construct, and "20" represents "mRNA0020" construct.
Figure 21A:
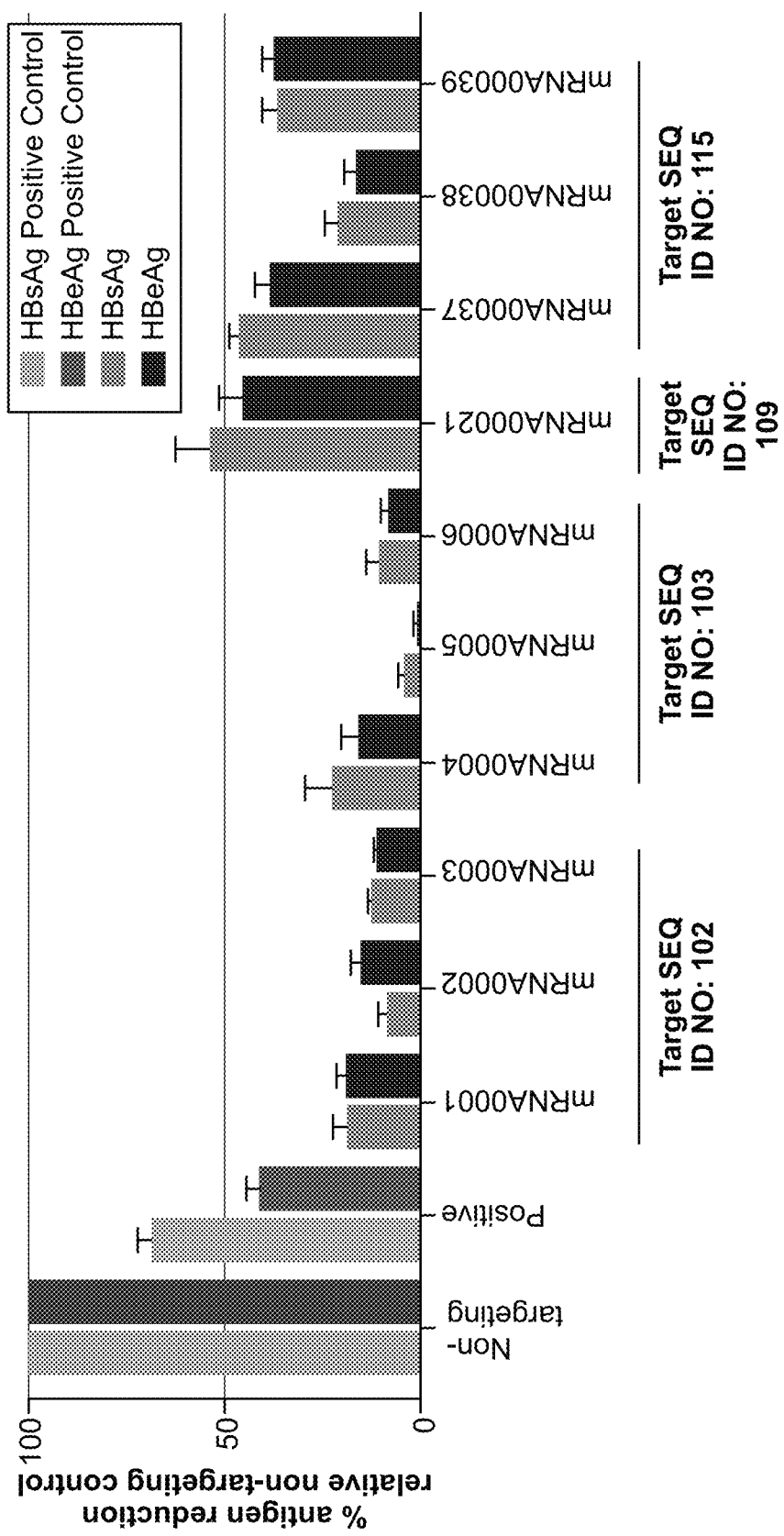
FIG. 21A is a graph summarizing the results of top ten ZF-off constructs from FIG. 20B.
Figure 21B:
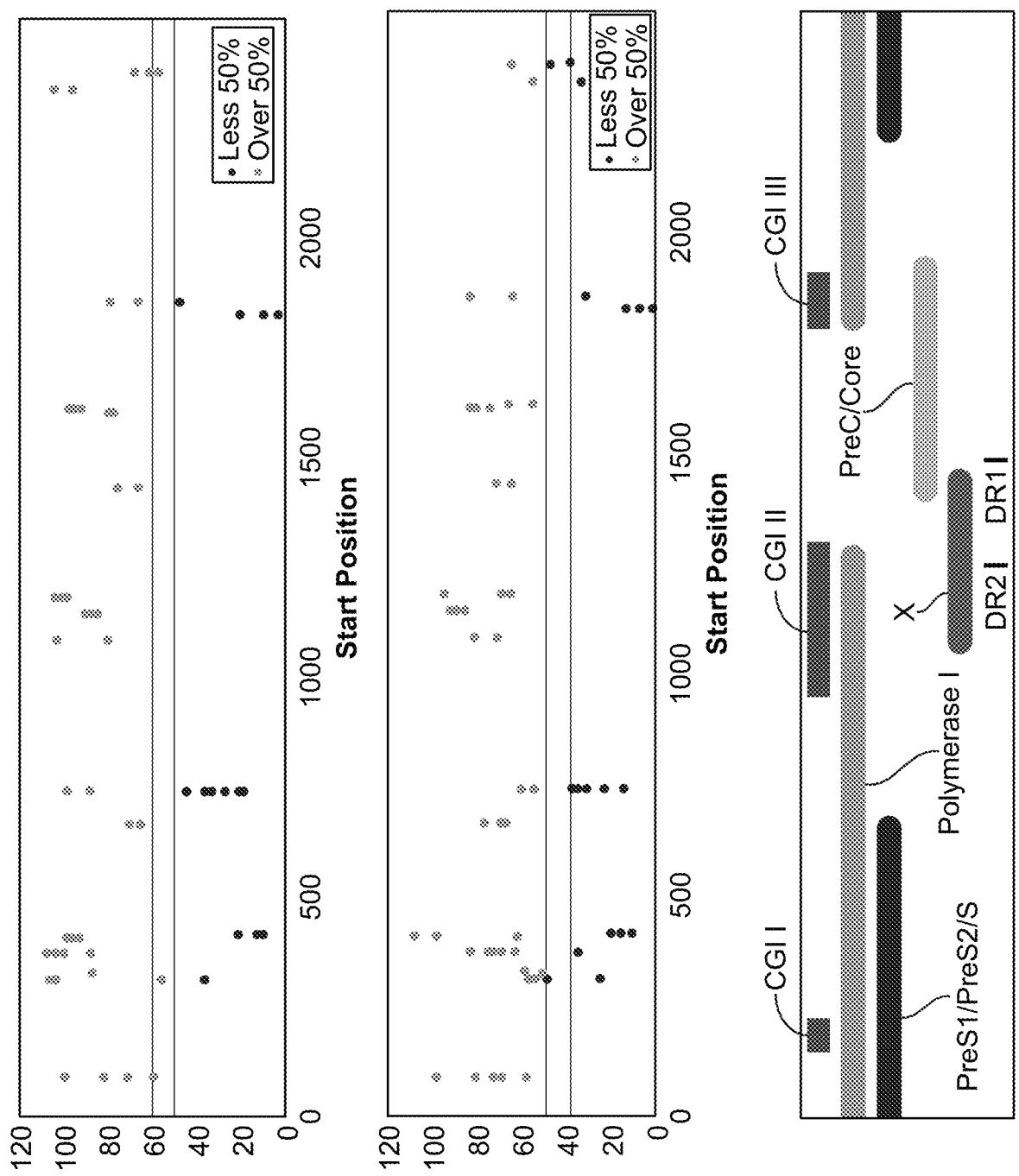
FIG. 21B is a diagram showing HBsAg (top) and HBeAg (middle) expression values measured in the ZF-off screen (calculated as a percentage of the expression of HBsAg or HBeAg—top and middle, respectively—measured for a non-targeting control). Each ZF-off construct is represented by a dot. 50% and 60% repression cutoffs are shown as horizontal lines. The position of the respective guide RNA within the HBV genome (bottom) is mapped on the X-axis.

Certain exemplary ZF-off constructs were formulated in a research-grade LNP. HepG2-NTCP cells were infected with HBV for 4 days and then transfected with the ZF-off loaded LNPs. As depicted in FIG. 20A, at Day 6 post-infection HBsAg and HBeAg protein expression in the supernatant was evaluated by ELISA. FIG. 20B shows the results as measured by percentage reduction in HBV antigens as compared to non-targeting control. Positive control used in this experiment is a HBV gRNA previously shown to reduce antigens ~50%. FIG. 21A shows the results of the top ten ZF-off constructs that lead to the most reduction in HBV antigens. FIG. 21B shows the results for all constructs in the screen.

Table 14 and 15 below show the raw data from these experiments, listed with the mRNA number yielding the zinc finger motif.

TABLE 14

% HBsAg expression relative to non-targeting control

| Trial# | 1 | 2 | 3 | 4 | 5 | 6 | 7 | 8 |
|---|---|---|---|---|---|---|---|---|
| Non-targ control | 100 | 100 | 100 | 100 | | | | |
| Pos control | 54 | 59 | 68 | 61 | 75 | 79 | 65 | 86 |
| mRNA0001 | 10 | 19 | 25 | 23 | | | | |
| mRNA0002 | 12 | 2 | 8 | 12 | | | | |
| mRNA0003 | 10 | 11 | 14 | 15 | | | | |
| mRNA0004 | 10 | 28 | 13 | 39 | | | | |
| mRNA0005 | 3 | 5 | 1 | 8 | | | | |
| mRNA0006 | 4 | 12 | 8 | 19 | | | | |
| mRNA0007 | 97 | 86 | 60 | 66 | | | | |
| mRNA0008 | 68 | 69 | 65 | 64 | | | | |
| mRNA0009 | 65 | 67 | 74 | 98 | | | | |
| mRNA0010 | 84 | 69 | 66 | 73 | | | | |
| mRNA0011 | 67 | 50 | 60 | 59 | | | | |
| mRNA0012 | 59 | 61 | 70 | 92 | | | | |
| mRNA0013 | 97 | 70 | 66 | 71 | | | | |
| mRNA0014 | 60 | 81 | 66 | 74 | | | | |
| mRNA0015 | 81 | 73 | 77 | 129 | | | | |
| mRNA0016 | 120 | 78 | 71 | 77 | | | | |
| mRNA0017 | 75 | 77 | 82 | 82 | | | | |
| mRNA0018 | 78 | 84 | 93 | 131 | | | | |
| mRNA0019 | 107 | 107 | 77 | 100 | | | | |
| mRNA0020 | 77 | 99 | 60 | 116 | | | | |
| mRNA0021 | 32 | 49 | 68 | 66 | | | | |
| mRNA0022 | 71 | 66 | 51 | 56 | | | | |
| mRNA0023 | 65 | 71 | 76 | 41 | | | | |
| mRNA0024 | 109 | 89 | 86 | 92 | | | | |
| mRNA0025 | 86 | 92 | 90 | 82 | | | | |
| mRNA0026 | 77 | 88 | 81 | 104 | | | | |

TABLE 14-continued

% HBsAg expression relative to non-targeting control

| Trial# | 1 | 2 | 3 | 4 | 5 | 6 | 7 | 8 |
|---|---|---|---|---|---|---|---|---|
| mRNA0027 | 128 | 77 | 80 | 81 | | | | |
| mRNA0028 | 71 | 67 | 59 | 66 | | | | |
| mRNA0029 | 48 | 47 | 40 | 57 | | | | |
| mRNA0030 | 109 | 82 | 76 | 75 | | | | |
| mRNA0031 | 46 | 32 | 41 | 27 | | | | |
| mRNA0032 | 50 | 59 | 52 | 73 | | | | |
| mRNA0033 | 61 | 62 | 46 | 50 | | | | |
| mRNA0034 | 51 | 24 | 41 | 25 | | | | |
| mRNA0035 | 30 | 25 | 24 | 34 | | | | |
| mRNA0036 | 16 | 22 | 19 | 19 | | | | |
| mRNA0037 | 54 | 43 | 42 | 46 | | | | |
| mRNA0038 | 19 | 23 | 13 | 29 | | | | |
| mRNA0039 | 28 | 46 | 37 | 36 | | | | |
| mRNA0040 | 88 | 78 | 83 | 80 | | | | |
| mRNA0041 | 103 | 92 | 100 | | | | | |
| mRNA0042 | 99 | 91 | 99 | | | | | |
| mRNA0043 | 93 | 89 | 97 | | | | | |
| mRNA0044 | 98 | 100 | 95 | | | | | |
| mRNA0045 | 100 | 96 | 95 | | | | | |
| mRNA0046 | 94 | 83 | 92 | | | | | |
| mRNA0047 | 97 | 77 | 99 | | | | | |
| mRNA0048 | 96 | 94 | 90 | | | | | |
| mRNA0049 | 88 | 87 | 89 | | | | | |
| mRNA0050 | 87 | 87 | 85 | | | | | |
| mRNA0051 | 106 | 104 | 114 | | | | | |
| mRNA0052 | 104 | 101 | 107 | | | | | |
| mRNA0053 | 88 | 86 | 92 | | | | | |
| mRNA0054 | 98 | 102 | 91 | | | | | |
| mRNA0055 | 101 | 96 | 100 | | | | | |
| mRNA0056 | 99 | 107 | 108 | | | | | |
| mRNA0057 | 101 | 102 | 104 | | | | | |
| mRNA0058 | 110 | 104 | 102 | | | | | |
| mRNA0059 | 100 | 91 | 98 | | | | | |
| mRNA0060 | 94 | 103 | 100 | | | | | |
| mRNA0061 | 104 | 96 | 103 | | | | | |
| mRNA0062 | 106 | 98 | 104 | | | | | |
| mRNA0063 | 96 | 86 | 99 | | | | | |

TABLE 15

% HBeAg expression relative to non-targeting control

| Trial# | 100 | 100 | 100 | 100 | | | | |
|---|---|---|---|---|---|---|---|---|
| Non-targ control | 100 | 100 | 100 | 100 | | | | |
| Pos control | 26 | 36 | 41 | 53 | 43 | 43 | 34 | 54 |
| mRNA0001 | 12 | 19 | 22 | 23 | | | | |
| mRNA0002 | 15 | 8 | 17 | 20 | | | | |
| mRNA0003 | 11 | 9 | 13 | 12 | | | | |
| mRNA0004 | 10 | 17 | 9 | 27 | | | | |
| mRNA0005 | 1 | 1 | −1 | 3 | | | | |
| mRNA0006 | 5 | 8 | 7 | 13 | | | | |
| mRNA0007 | 95 | 78 | 59 | 65 | | | | |
| mRNA0008 | 64 | 67 | 60 | 65 | | | | |
| mRNA0009 | 65 | 64 | 81 | 98 | | | | |
| mRNA0010 | 84 | 68 | 69 | 70 | | | | |
| mRNA0011 | 65 | 51 | 51 | 67 | | | | |
| mRNA0012 | 64 | 61 | 74 | 96 | | | | |
| mRNA0013 | 92 | 74 | 73 | 79 | | | | |
| mRNA0014 | 58 | 85 | 58 | 76 | | | | |
| mRNA0015 | 82 | 83 | 78 | 124 | | | | |
| mRNA0016 | 108 | 81 | 72 | 80 | | | | |
| mRNA0017 | 72 | 77 | 72 | 80 | | | | |
| mRNA0018 | 55 | 55 | 71 | 93 | | | | |
| mRNA0019 | 71 | 79 | 51 | 87 | | | | |
| mRNA0020 | 34 | 36 | 32 | 52 | | | | |
| mRNA0021 | 32 | 40 | 55 | 55 | | | | |
| mRNA0022 | 77 | 64 | 53 | 65 | | | | |
| mRNA0023 | 60 | 69 | 72 | 43 | | | | |
| mRNA0024 | 98 | 76 | 87 | 84 | | | | |
| mRNA0025 | 91 | 86 | 82 | 92 | | | | |
| mRNA0026 | 78 | 97 | 87 | 102 | | | | |
| mRNA0027 | 117 | 62 | 68 | 74 | | | | |

TABLE 15-continued

% HBeAg expression relative to non-targeting control

| Trial# | 100 | 100 | 100 | 100 |
|---|---|---|---|---|
| mRNA0028 | 75 | 59 | 58 | 71 |
| mRNA0029 | 31 | 32 | 22 | 45 |
| mRNA0030 | 124 | 86 | 79 | 77 |
| mRNA0031 | 42 | 23 | 27 | 20 |
| mRNA0032 | 46 | 57 | 57 | 82 |
| mRNA0033 | 56 | 51 | 44 | 76 |
| mRNA0034 | 42 | 21 | 41 | 18 |
| mRNA0035 | 22 | 22 | 24 | 39 |
| mRNA0036 | 13 | 17 | 16 | 13 |
| mRNA0037 | 50 | 35 | 34 | 35 |
| mRNA0038 | 12 | 16 | 13 | 25 |
| mRNA0039 | 29 | 45 | 39 | 36 |
| mRNA0040 | 93 | 73 | 80 | 82 |
| mRNA0041 | 80 | 63 | 111 | |
| mRNA0042 | 114 | 94 | 98 | |
| mRNA0043 | 98 | 91 | 99 | |
| mRNA0044 | 91 | 115 | 108 | |
| mRNA0045 | 71 | 55 | 62 | |
| mRNA0046 | 76 | 66 | 63 | |
| mRNA0047 | 55 | 55 | 45 | |
| mRNA0048 | 66 | 63 | 78 | |
| mRNA0049 | 83 | 59 | 52 | |
| mRNA0050 | 51 | 55 | 49 | |
| mRNA0051 | 55 | 49 | 49 | |
| mRNA0052 | 56 | 57 | 66 | |
| mRNA0053 | 92 | 60 | 57 | |
| mRNA0054 | 50 | 55 | 56 | |
| mRNA0055 | 83 | 88 | 74 | |
| mRNA0056 | 61 | 69 | 112 | |
| mRNA0057 | 106 | 73 | 65 | |
| mRNA0058 | 66 | 65 | 65 | |
| mRNA0059 | 69 | 66 | 71 | |
| mRNA0060 | 59 | 94 | 101 | |
| mRNA0061 | 111 | 81 | 68 | |
| mRNA0062 | 28 | 33 | 41 | |
| mRNA0063 | 65 | 55 | 31 | |

Example 8. Dose Response Testing of Viral Antigens in HepG2-NTCP Cells

Figure 22:
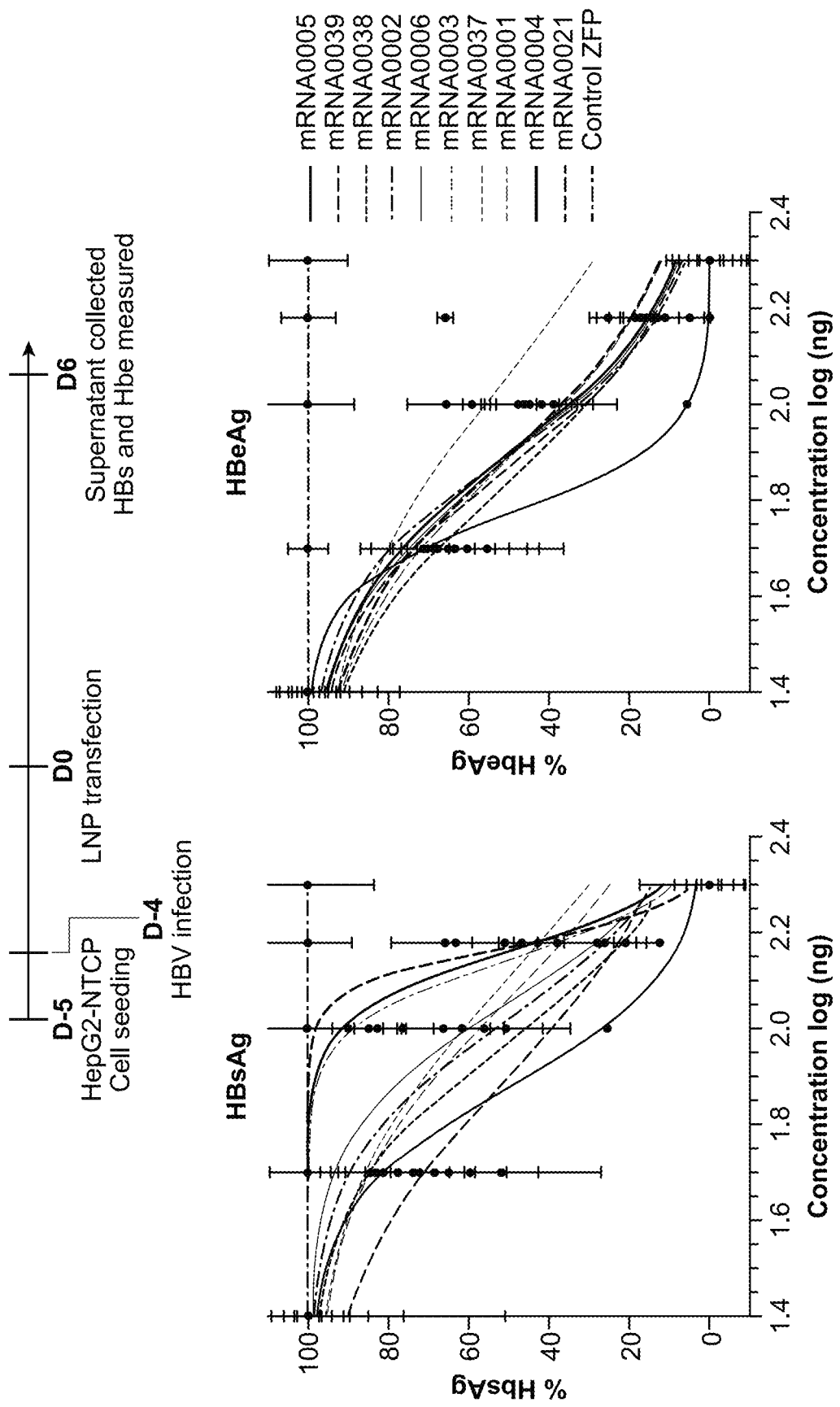
FIG. 22 is an experimental timeline for testing dose response (top) and two graphs showing dose response of % HbsAg (bottom left) and % HbeAg (bottom right) in HepG2-NTCP cells upon administration of ZF fusion proteins. The mRNA corresponding to the ZF motif for each fusion protein is indicated.

In this example, top ZF fusion proteins were tested in 5-point dose response assay for HBsAg and HBeAg. The 5 dosage points were 200ng, 150ng, 100ng, 50ng, and 25ng. Experimental schematic and results are shown in FIG. 22.

Example 9. Testing for Durable Repression of HBsAg in HepG2.2.15 Cells

Figure 23A:
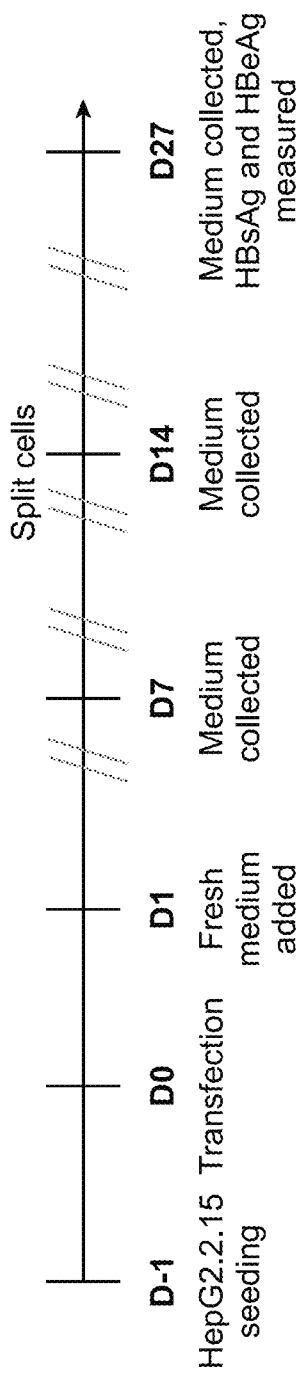
FIGS. 23A-23C show an experimental timeline for testing durable silencing of HBsAg (FIG. 23A), a graph showing the durability of HBsAg silencing by ZF fusion proteins (FIG. 23B), and a graph showing the durability of HBsAg silencing by CRISPR-off fusion proteins with guide RNAs (FIG. 23C) in an integrated cell line. The mRNA corresponding to the ZF motif for each fusion protein is indicated. Error bars represent mean +/− SEM.
Figure 23B:
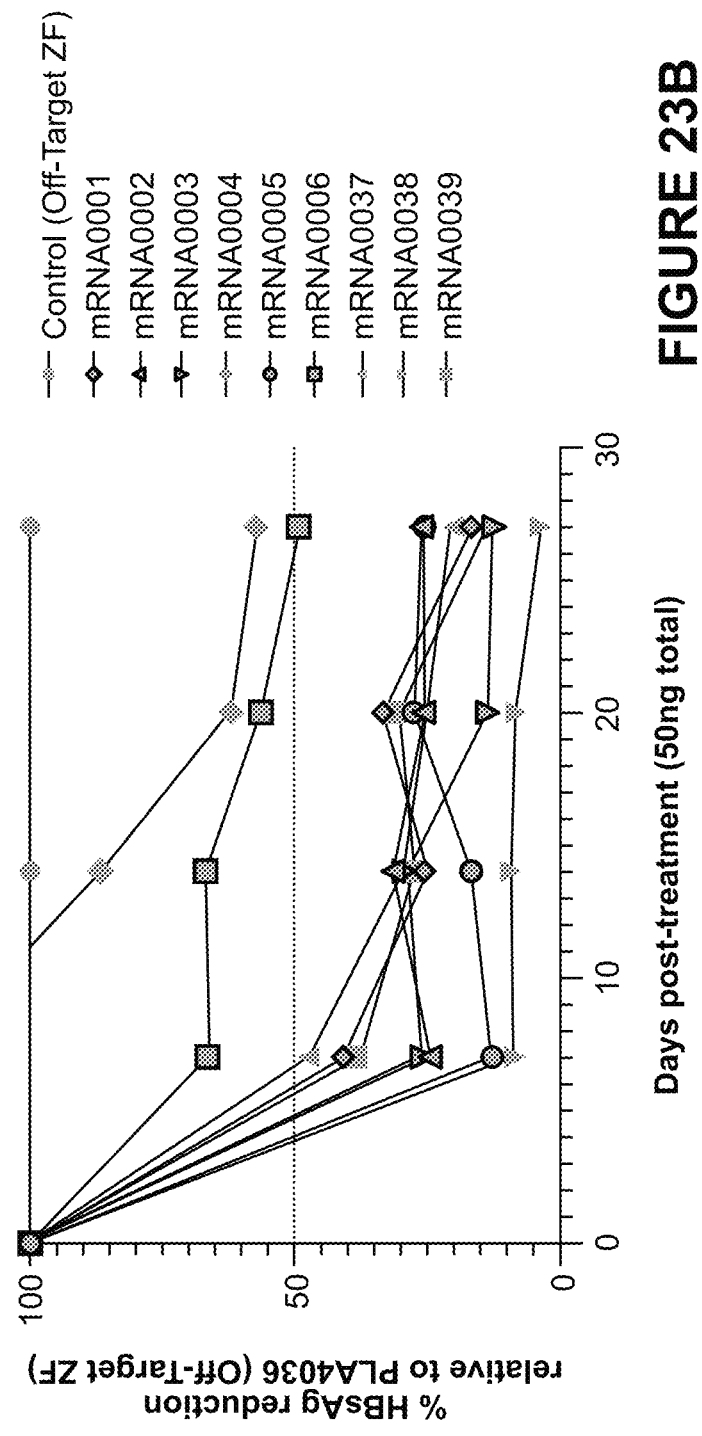
Figure 23C:
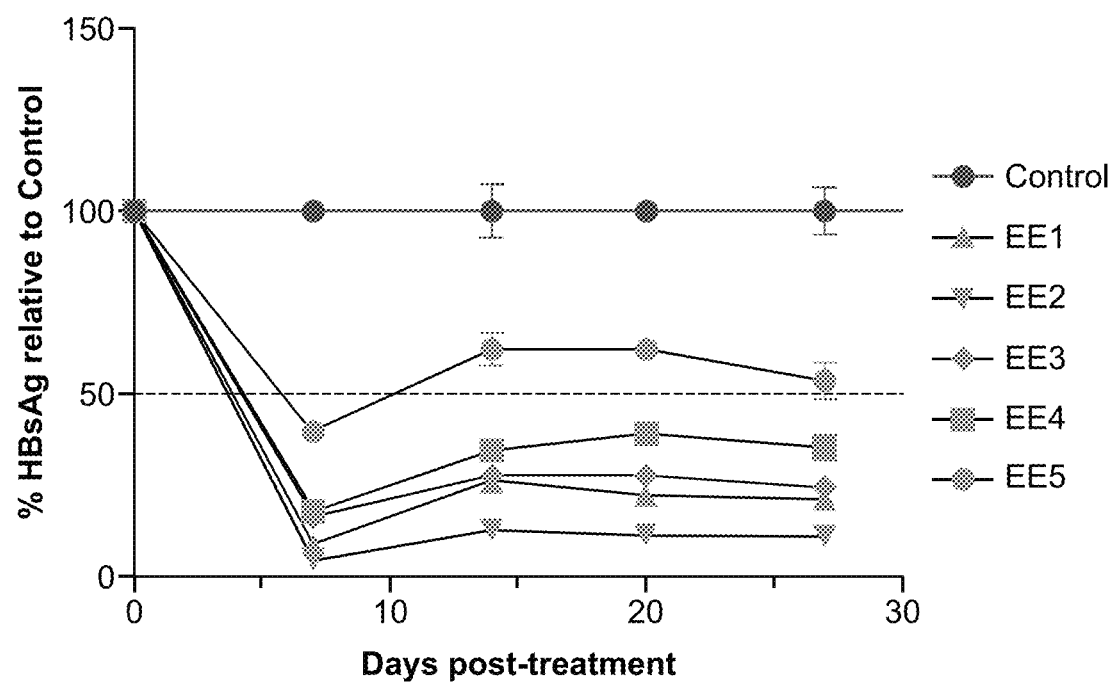

In this example, top ZF and CRISPR-off fusion proteins with guide RNAs were tested for durable repression of HBsAg. Active ZFPs and CRISPR-off editors showed durable silencing through Day 27 with 50ng treatment. Experimental schematic and results are shown in FIGS. 23A-23C.

Example 10. Testing of Silencing of HBsAg in a Second Model for Int-HBV

Figure 24:
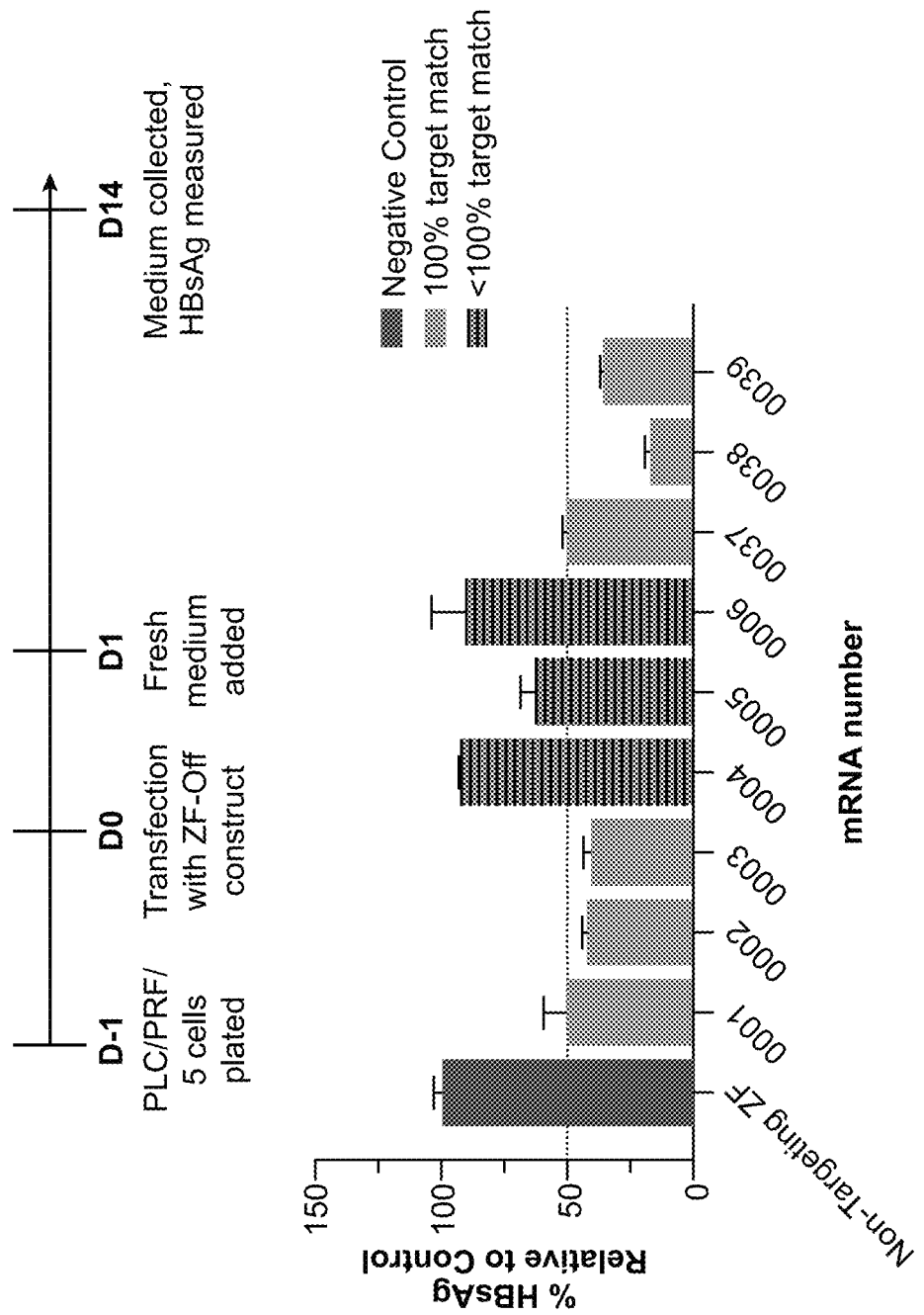
FIG. 24 is an experimental timeline for testing HBsAg silencing in a PLC/PRF/5 in vitro model (top) and a graph showing % HBsAg relative to control on Day 14 after administration of ZF fusion proteins. The mRNA corresponding to the ZF motif for each fusion protein is indicated. Information about the % match to target for each construct is also indicated.
Figure 25A:
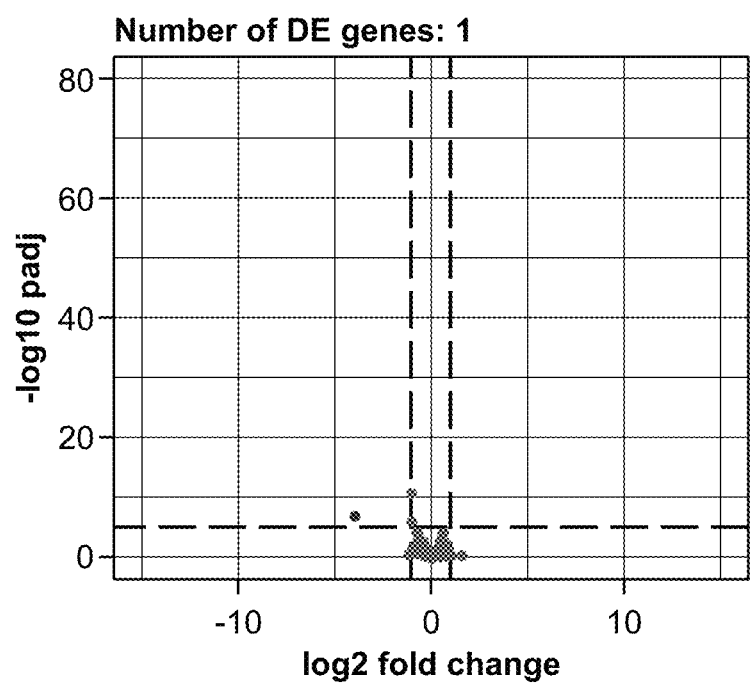
FIG. 25A is a volcano plot showing differentially expressed (DE) genes for an exemplary ZF specificity assay. DE genes are shown with dots.
Figure 25B:
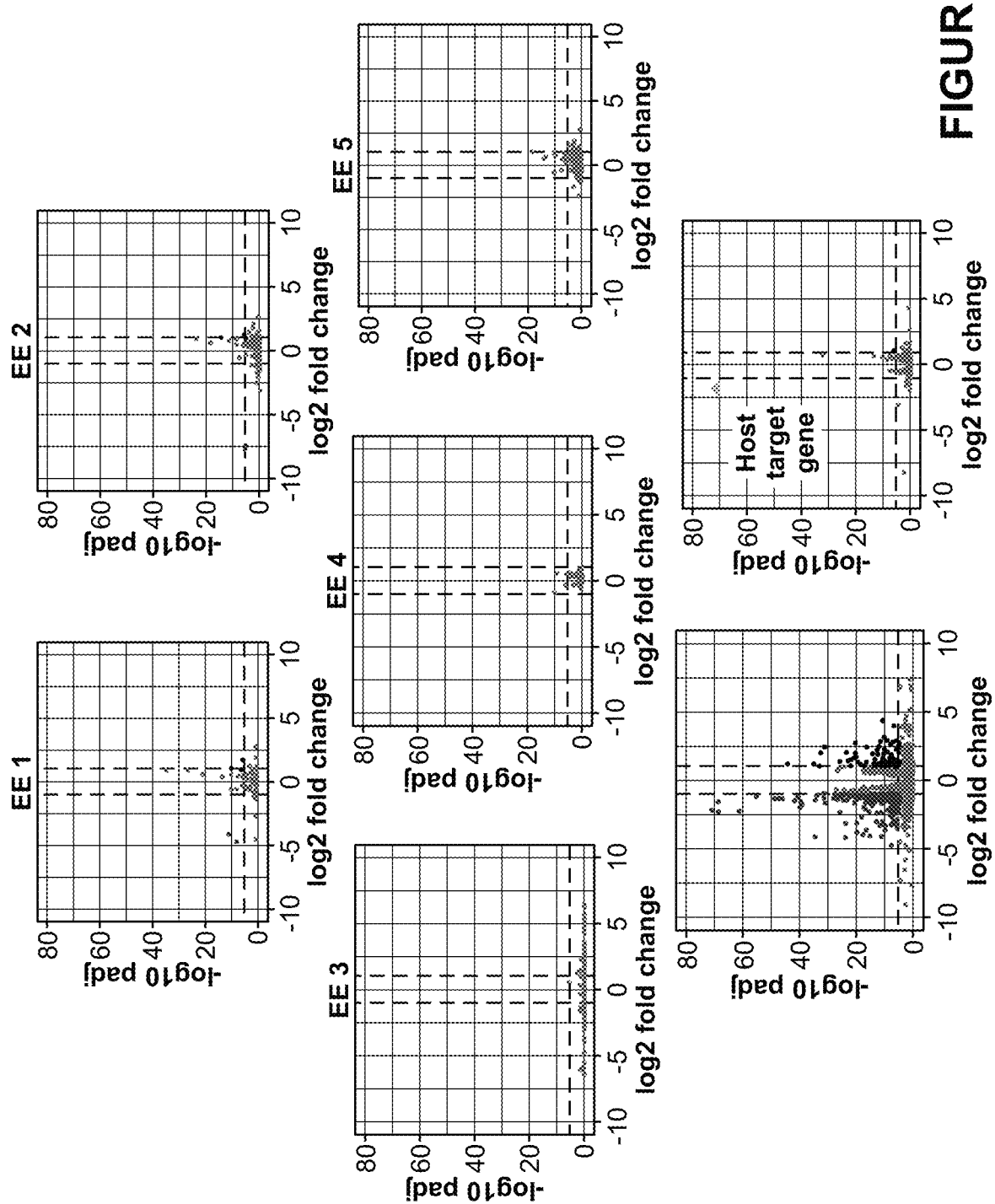
FIG. 25B is a volcano plot showing DE for CRISPR-off and gRNA epigenetic editors. Points represent genes with their change in expression (x-axis) and statistical significance of that change (y-axis). EE1=PLA002 and gRNA #007, EE2=PLA002 and gRNA #008, EE3=PLA002 and gRNA #009, EE4=PLA002 and gRNA #015, and EE5=PLA002 and gRNA #011. Also shown are results for low specificity and host target gene controls.
Figure 25C:
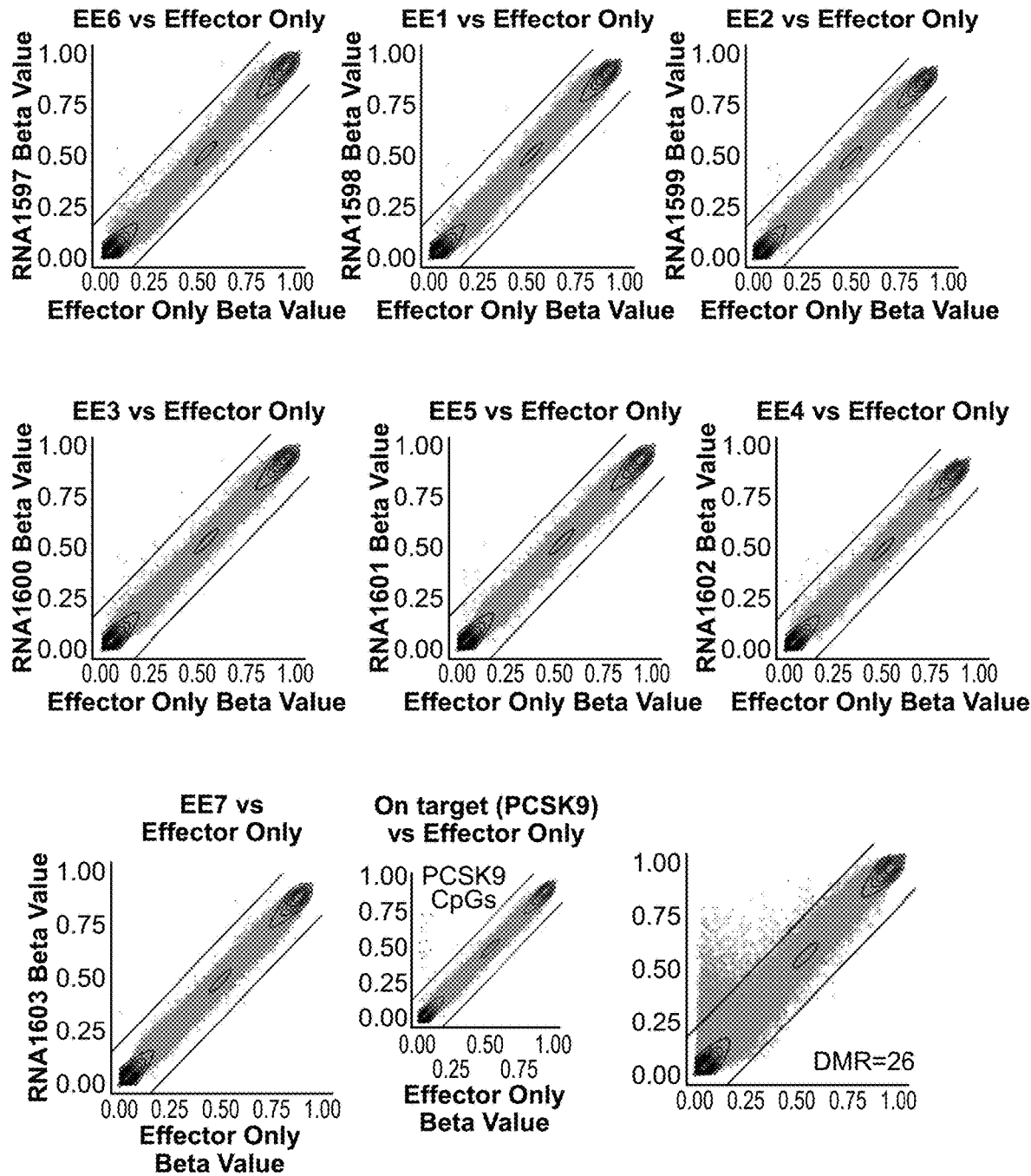
FIGS. 25C-25D are scatter plots showing methylation levels between treatment (y-axis) and control (x-axis) for 935,000 CpG sites in the human genome. Lines represent thresholds for changes in methylation considered significant (absolute [methylation difference]>=0.2). DMRs are noted on each figure. Results for a host target (PCSK9, next-to-final panel) as well as a low specificity control (final panel) are also shown.
Figure 25D:
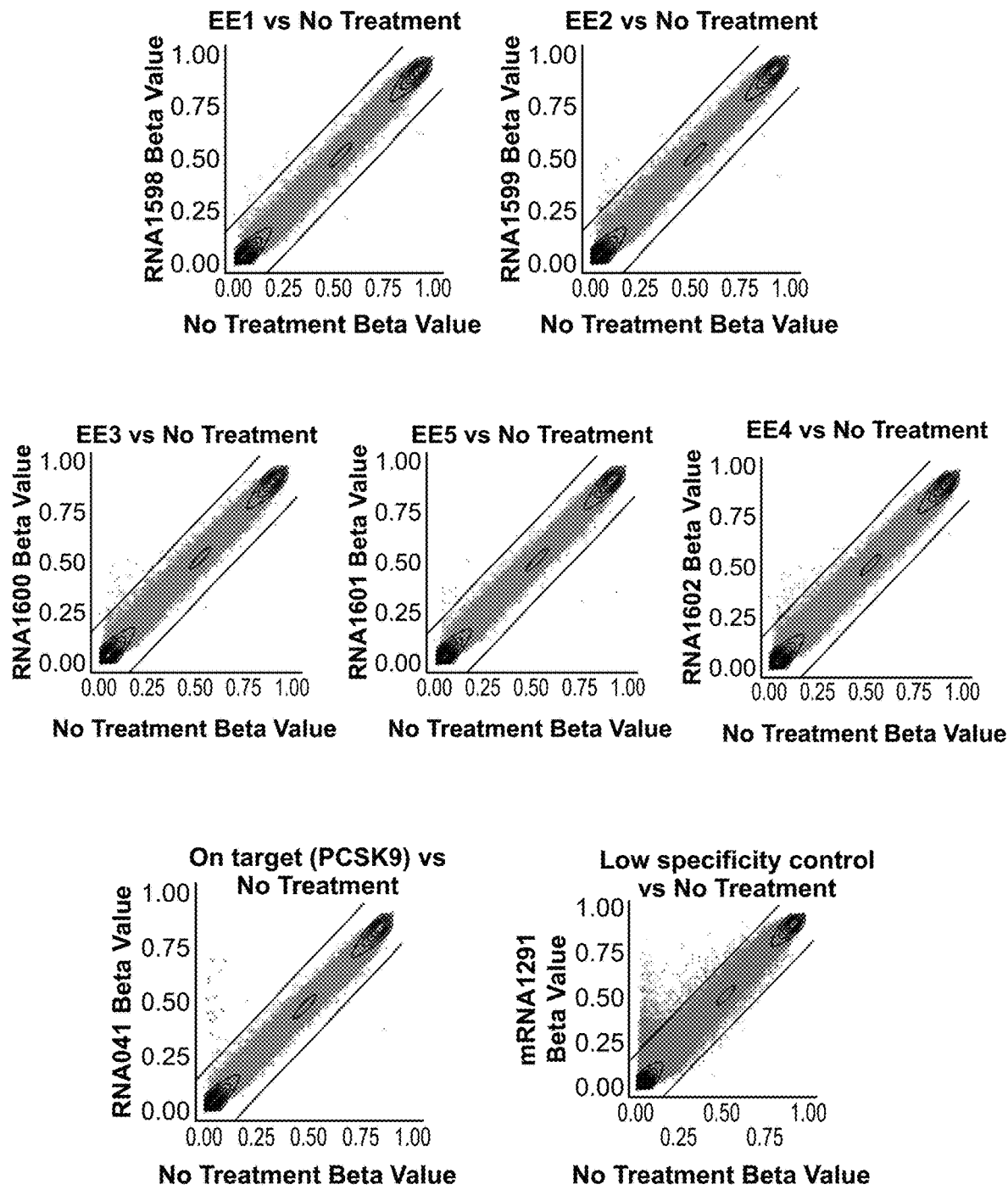

In this example, top ZF fusion proteins were tested for repression of HBsAg in PLC/PRF/5 cells. A subset of the ZFPs silenced HBsAg in this second model. Experimental schematic and results are shown in FIG. 24. 1. Testing ZF Fusion Proteins and CRISPR-off with guide RNAs for Specificity In this example, ZF fusion proteins targeting HBV exhibiting significant silencing were profiled for specificity in HepG2-NTCP at day 19. All comparisons were performed against a non-targeting ZFP control. An exemplary result for the ZF fusion protein with mRNA0001 zinc finger motif is shown in FIG. 25A. CRISPR-off with guide RNAs were similarly profiled. HepG2-NTCP cells were transfected with 100 ng of total payload using GenVoy™ LNP at a 1:1 gRNA:effector ratio. Cells were split every 3-4 days and collected at day 15 post-treatment for specificity assessments, including RNA-seq and methylation array. DESeq2 was used to identify differential gene expression. As shown in FIG. 25B, little to no changes were observed above chosen thresholds (absolute[log 2[fold change]]>1 and −log 10[adjusted p-value]>5) as expected for effectors targeting HBV DNA. For methylation array, the Infinium MethylationEPIC v2.0 array was used, and DMRs were identified using Bumphunter. EE3, EE4, and EE5 had a result of DMR=0. Results are shown in FIGS. 25C-25D.

Example 11. In Vivo Analysis of ZF-Off Constructs

Figure 26:
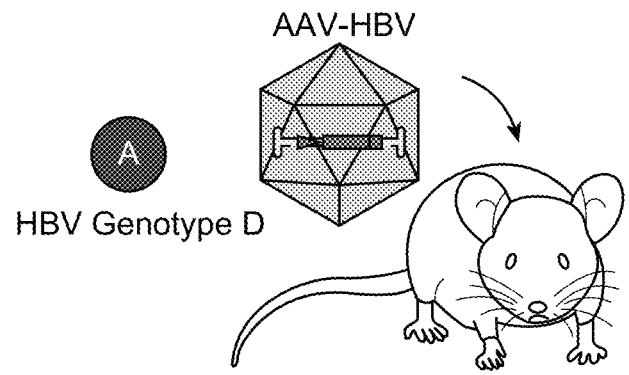
FIG. 26 is a schematic of an in vivo experiment testing ZF-off constructs.
Figure 26:
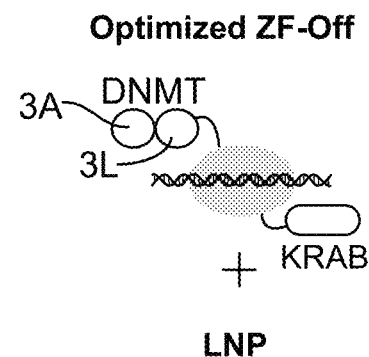
Figure 26:
Figure 26:
Figure 27:
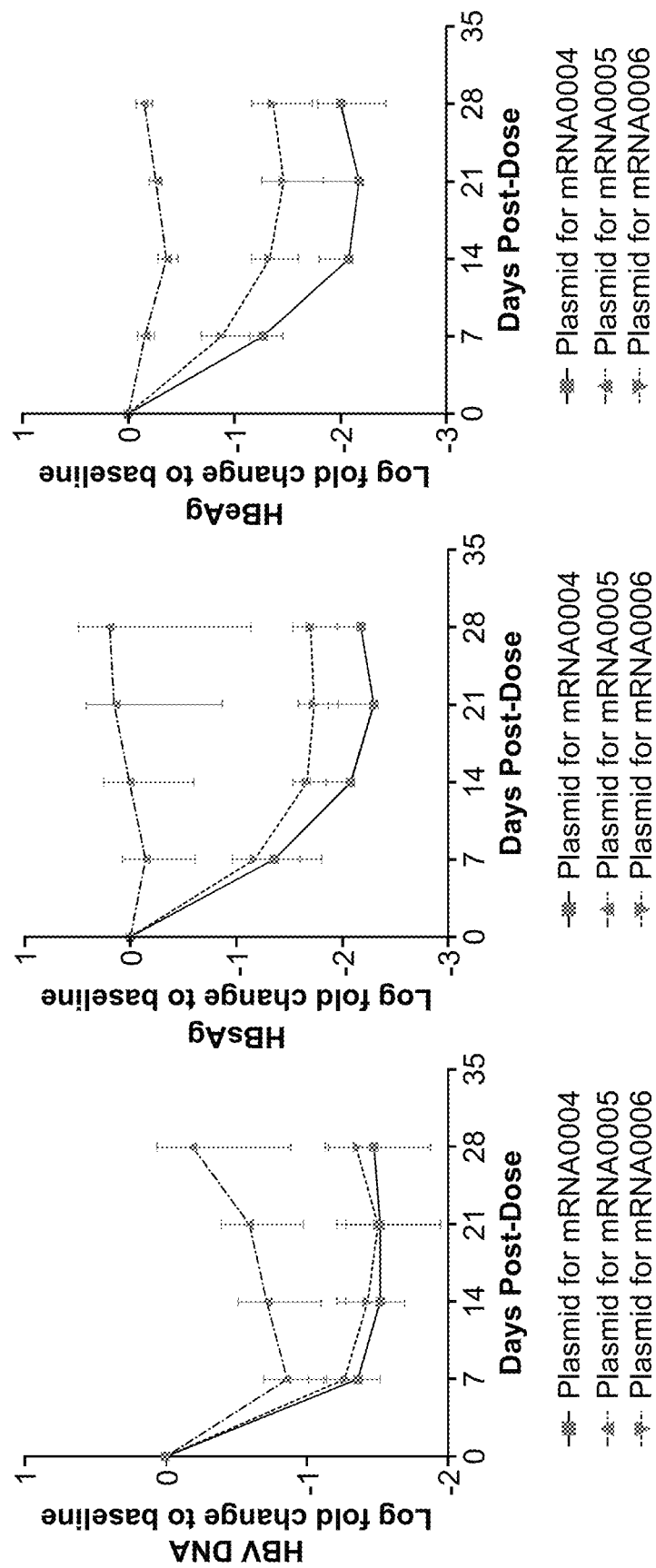
FIG. 27 shows graphs showing log fold change, relative to baseline, for HBV DNA (left), HBsAg (middle), and HBeAg (right) in plasma of mice treated with the plasmids indicated in the experiment shown in FIG. 26.

Ten ZF-Off constructs as well as vehicle-only and CRISPR-Off controls were administered to AAV-HBV mice at 1 mg/kg as shown in the schematic in FIG. 26. Table 16 shows the zinc finger motifs for each experimental group; the corresponding plasmid from Table 18, comprising the nucleic acid encoding the ZF-Off construct, was administered. Plasma from the mice was tested at Days 7, 14, 21, and 28 post dose for HBV DNA, HBsAg, and HBeAg. The livers were collected for further analysis. Results are shown in FIG. 27. The ZF-Off construct with the ZF motif from mRNA0004 showed more than a 1.5 log reduction in HBV DNA, a >2 log reduction in HSbsAg, and a >2 log reduction of HBeAg, all sustained up to 28 days from the dose.

TABLE 16

Experimental groups for in vivo testing of ZF-Off constructs.

| Group | ZF motif in construct administered | N |
|---|---|---|
| 1 | mRNA0001 | 6 |
| 2 | mRNA0002 | 6 |
| 3 | mRNA0003 | 6 |
| 4 | mRNA0005 | 6 |
| 5 | mRNA0006 | 6 |
| 6 | mRNA0038 | 6 |
| 7 | mRNA0004 | 6 |
| 8 | mRNA0039 | 6 |
| 9 | mRNA0021 | 6 |
| 10 | mRNA0037 | 6 |

Figure 28:
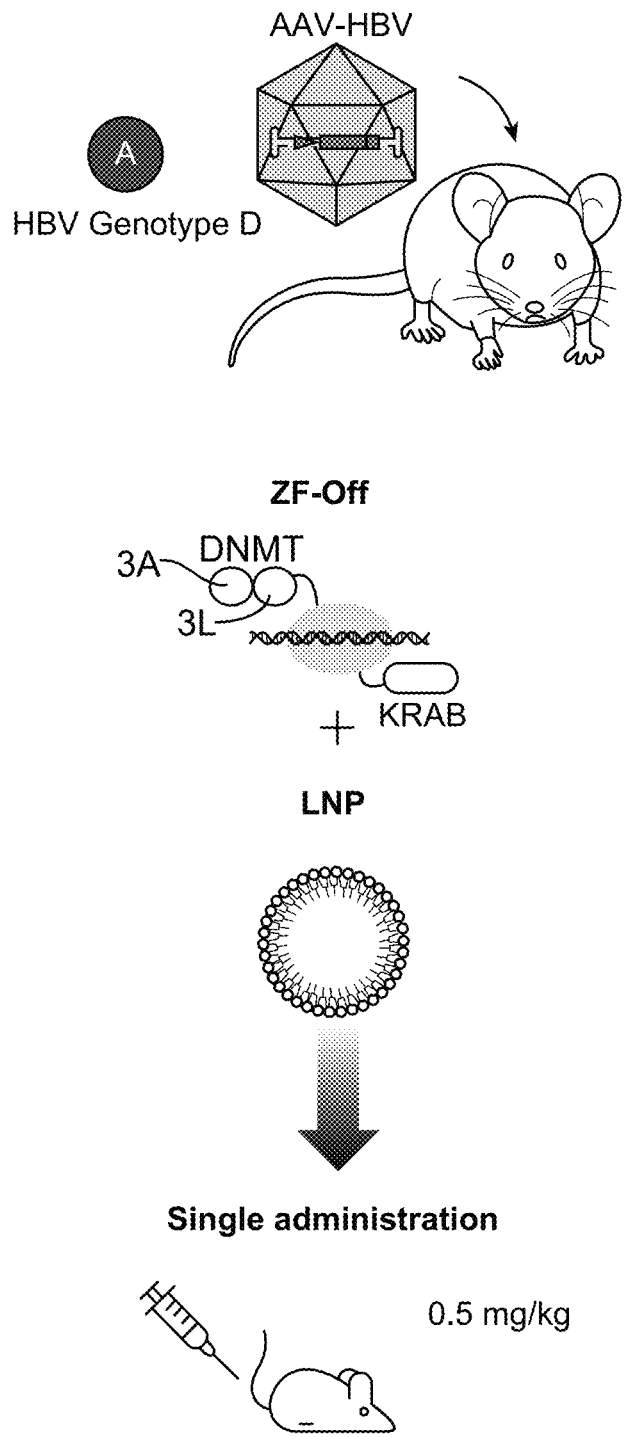
FIG. 28 is an experimental schematic for an in vivo study of multiplexing ZF fusion protein effectors.

Example 12. Zinc Finger Protein Multiplexing Study in an AAV-HBV and Tg-HBV Mouse Model AAV-HBV mice are injected with a single administration at 0.5 mg/kg of one, two, or three ZF fusion proteins, delivered as mRNA, in LNPs (schematic, FIG. 28) in accordance with Table 17. HBV DNA, HBsAg, and HBeAg are assayed in plasma at one or more time points, and the mouse liver is collected for further analysis.

TABLE 17

Multiplexing sample groups.

| Group | ZF_Off-1 | ZF_Off-2 | ZF_Off-3 |
|---|---|---|---|
| 1 | mRNA0004 | mRNA0021 | — |
| 2 | mRNA0004 | mRNA0003 | |

TABLE 17-continued

Multiplexing sample groups.

| Group | ZF_Off-1 | ZF_Off-2 | ZF_Off-3 |
|---|---|---|---|
| 3 | mRNA0004 | mRNA0038 | — |
| 4 | mRNA0004 | mRNA0021 | mRNA0003 |
| 5 | mRNA0004 | mRNA0038 | mRNA0003 |
| 6 | mRNA0004 | mRNA0021 | mRNA0038 |
| 7 | mRNA0004 | mRNA0001 | — |
| 8 | mRNA0004 | mRNA0039 | — |
| 9 | mRNA0004 | — | — |
| 10 | Vehicle | — | — |

Example 13. Dose Response for CRISPR-Off Constructs in an AAV In Vivo Model

Figure 29:
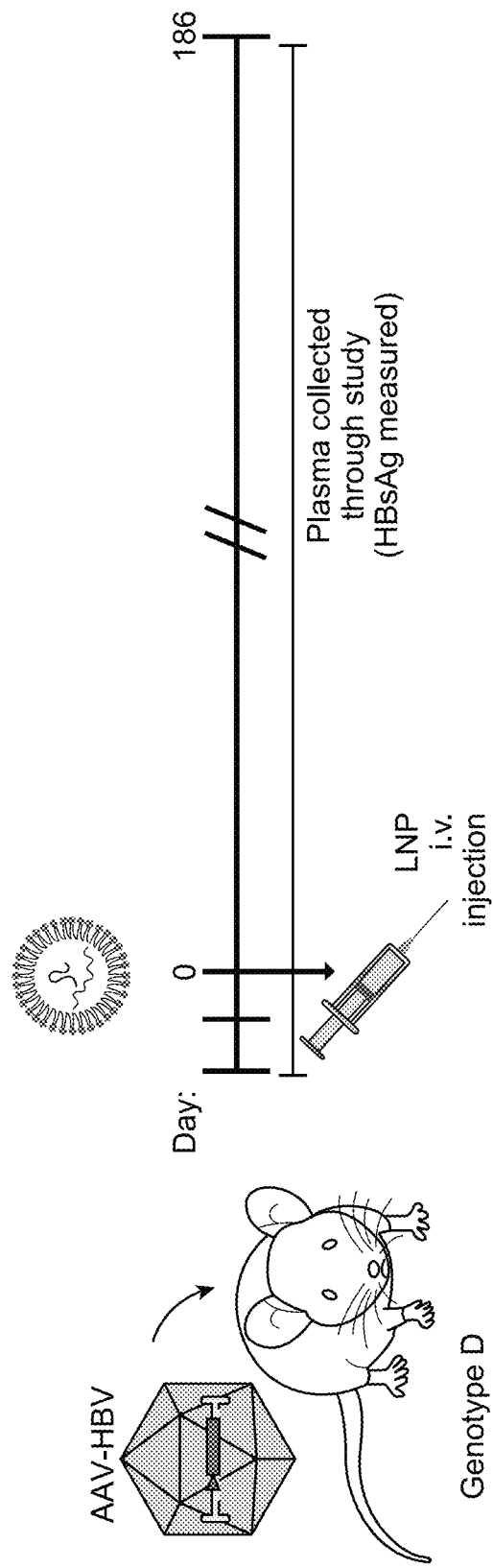
FIG. 29 is a schematic for a dose response experiment using CRISPR-Off in an AAV-HBV in vivo model.
Figure 30:
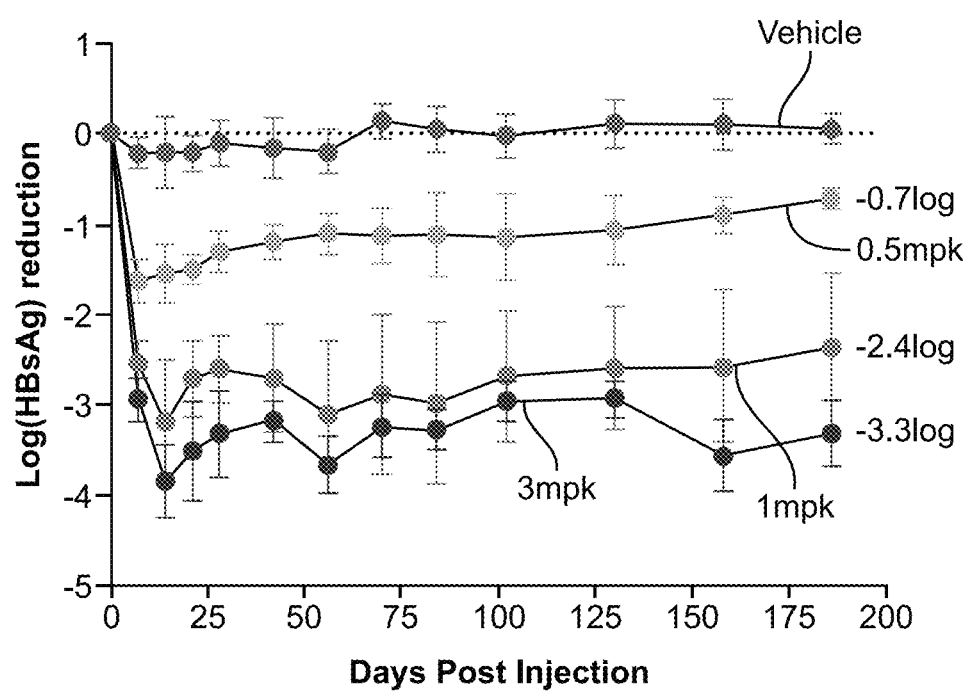
FIG. 30 is a line graph of plasma HBsAg levels for a dose response experiment using CRISPR-Off in an AAV-HBV in vivo model.

A single dose of CRISPR-Off (SEQ ID NO: 1248) mRNA with guide RNA #008 as well as vehicle-only control was tested via 1:1 mRNA:guide RNA administration to AAV-HBV mice at 0.5 mg/kg, 1 mg/kg, or 3 mg/kg in LNPs as shown in the schematic in FIG. 29. Plasma from the mice was tested for HBsAg at thirteen time points through 186 days after injection. Results are shown in FIG. 30. The highest dose administered showed an approximately 3.3 log reduction in HBsAg, sustained through 186 days after the dose.

Example 14. Dose Response for CRISPR Off Constructs in Tg In Vivo Model

Figure 31:
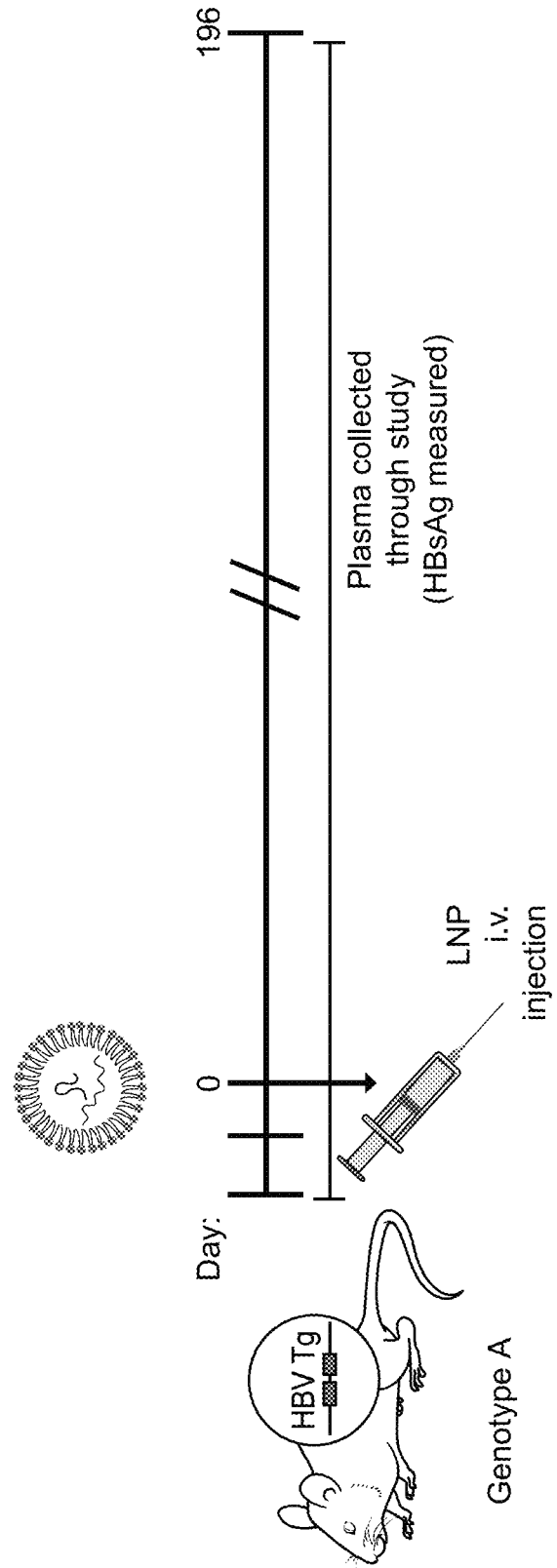
FIG. 31 is a schematic for a dose response experiment using CRISPR-Off in a Tg-HBV in vivo model.
Figure 32:
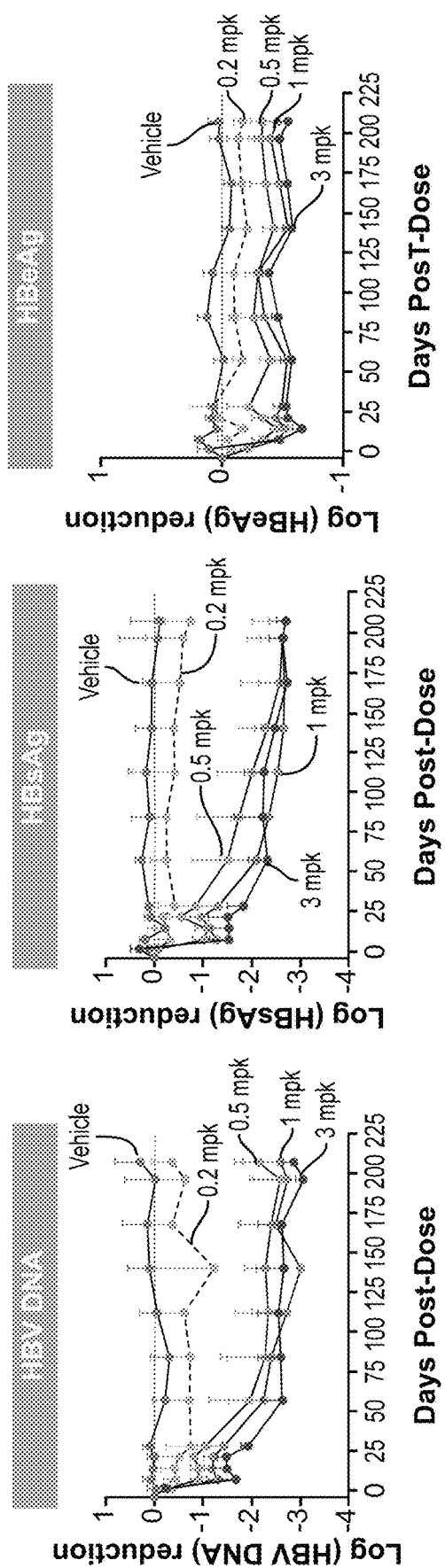
FIG. 32 shows line graphs of plasma HBV DNA, HBsAg, and HBeAg levels for a dose response experiment using CRISPR-Off in a Tg-HBV in vivo model.

A single dose of CRISPR-Off (SEQ ID NO: 1248) mRNA with guide RNA #008 as well as vehicle-only control was tested via 1:1 mRNA:guide RNA administration to Tg-HBV mice at 0.5 mg/kg, 1 mg/kg, or 3 mg/kg in LNPs as shown in the schematic in FIG. 31. Plasma from the mice was tested for HBsAg at thirteen time points through 186 days after injection. Results are shown in FIG. 32. The highest dose administered showed an approximately 2.6 log reduction in HBsAg, sustained through 196 days after the dose.

Figure 33:
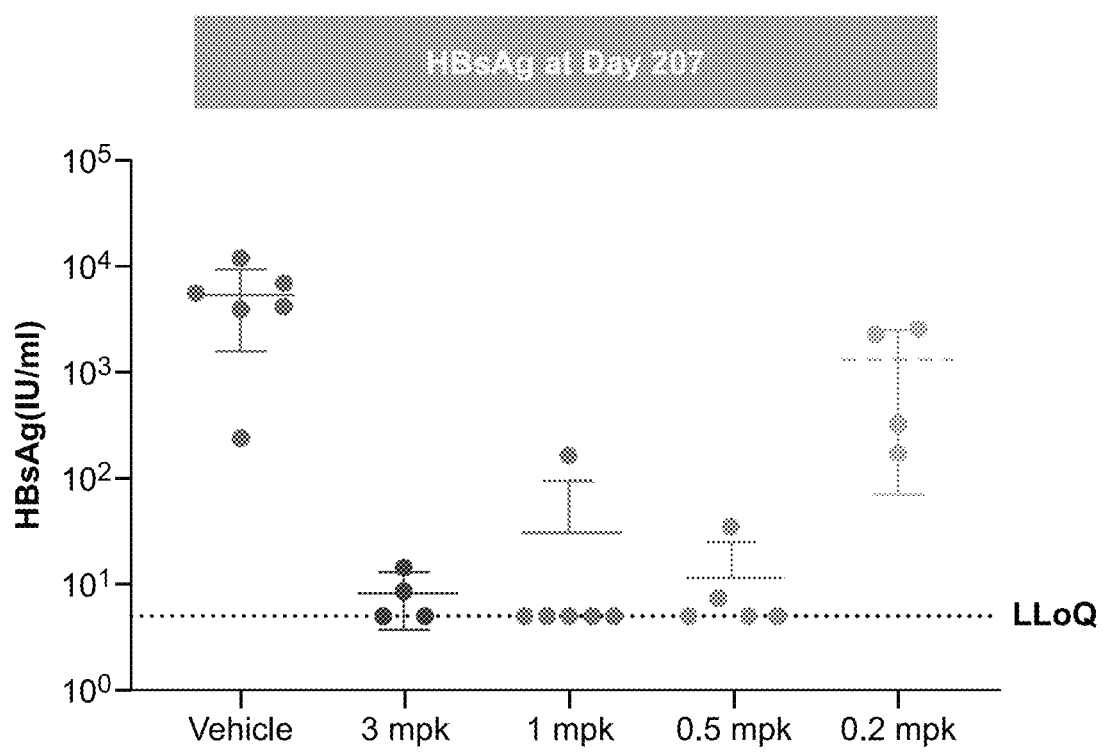
FIG. 33 is a dot plot of HBsAg levels of individual mice at the 207 day time point of a dose response experiment using CRISPR-Off in a Tg-HBV in vivo model.

A second dose response experiment in Tg-HBV model using CRISPR-Off (SEQ ID NO: 1248) mRNA with guide RNA #008 formulated in LNPs was conducted, with administrations at 0.2 mg/kg, 0.5 mg/kg, 1 mg/kg, or 3 mg/kg of 1:1 mRNA:guide RNA. A vehicle-only control was also used. In this experiment, plasma was tested for HBV DNA, HBsAg, and HBeAg at 13 time points through 207 days after injection. Results are shown in FIG. 32. The HBsAg results for individual mice at the final time point of 207 days after injection are plotted in FIG. 33. All of the mice in the 0.5 mg/kg, 1 mg/kg, and 3 mg/kg group had reduced HBsAg at Day 207 as compared to vehicle only control. Alanine transaminase (ALT) level in the mice was also tested at 207 days and found to be comparable to that of healthy untreated mice for all treatment groups.

Example 15. Guide RNA Testing in AAV-HBV Mice

Figure 34:
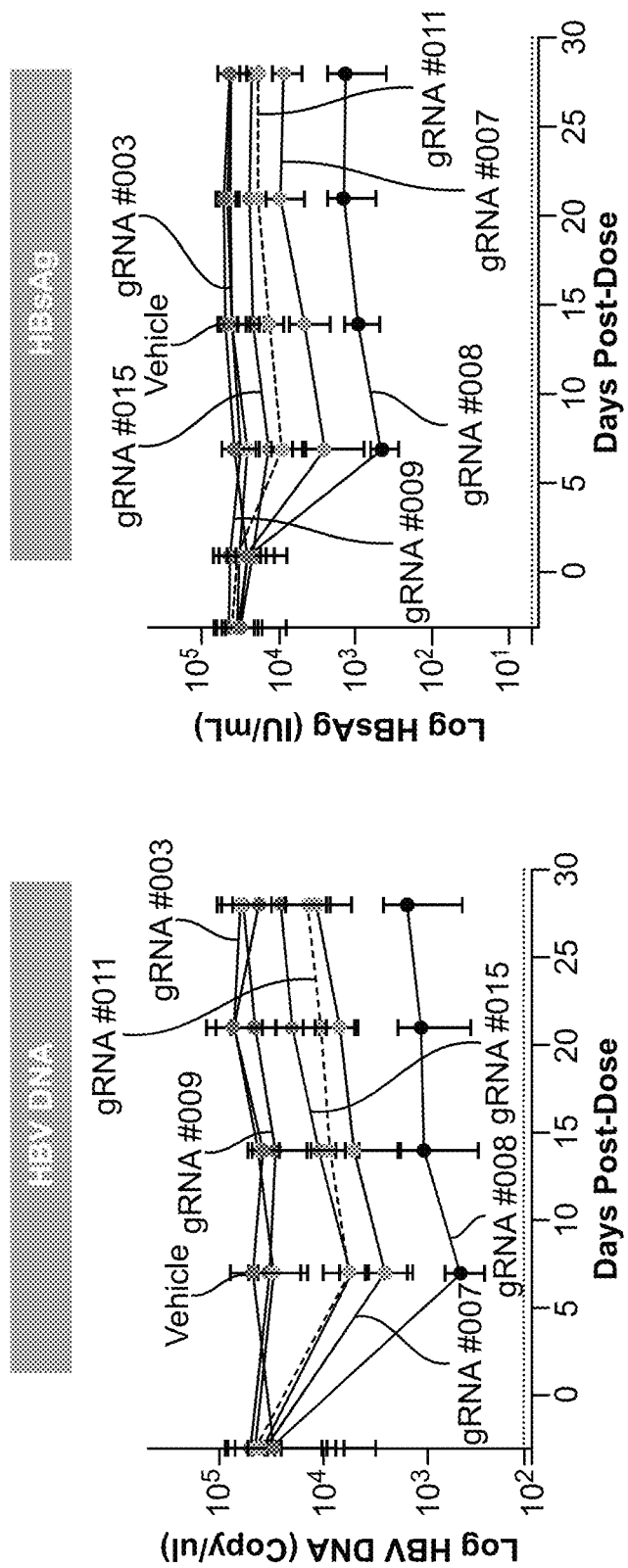
FIG. 34 shows line graphs of HBV-DNA and HBsAg in plasma in AAV mice treated with CRISPR-Off mRNA with various single guide RNAs. n=5 for each guide RNA treatment group; n=4 for vehicle-only control.

Six guide RNAs were tested for relative efficacy using CRISPR-Off (SEQ ID NO: 1248) in a 28-day, single-dose study. CRISPR-Off construct mRNA and one of gRNA #003, gRNA #007, gRNA #008, gRNA #009, gRNA #011, and gRNA #015 was delivered at 1:1 mRNA:guide RNA at 1 mg/kg. Controls included vehicle only, CRISPRi with gRNA #008 (not shown), and wild type Cas9 with gRNA #011 (not shown). HBV DNA and HBsAg was measured over 28 days. Results are shown in FIG. 34. Most of the single guide treatments tested in this experiment resulted in decreased HBV DNA and HBsAg versus vehicle only control.

Figure 35A:
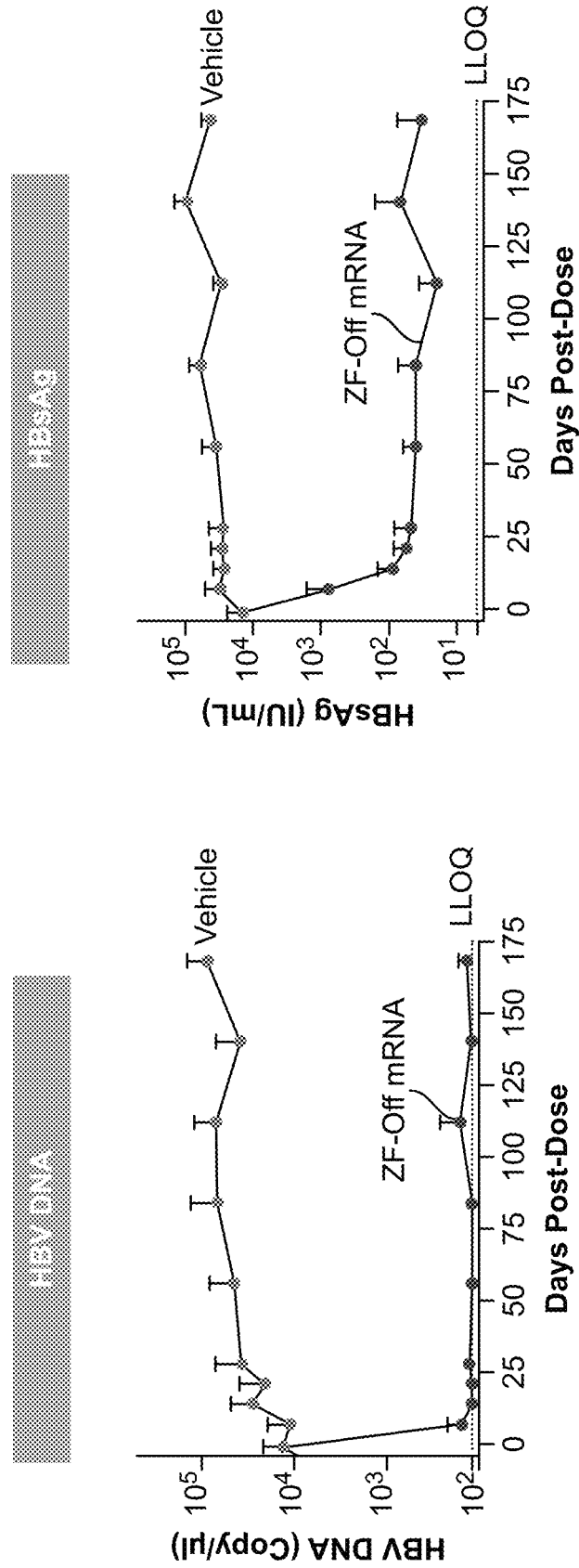
FIG. 35A shows line graphs of HBV-DNA and HBsAg in plasma in AAV mice treated with a single dose of ZF-Off mRNA.

Example 16. Durability Study for ZF-Off in AAV-HBV In Vivo Model: Single and Re-Dose Mice were injected with a single dose ZF-Off construct (SEQ ID NO: 36) mRNA at 1 mg/kg in LNPs. HBV DNA and HBsAg were measured from plasma over a period of 168 days. Results are shown in FIG. 35A. The treatment resulted in a sustained reduction of greater than 2 log in HBV DNA and similar sustained reduction in HBsAg.

Figure 35B:
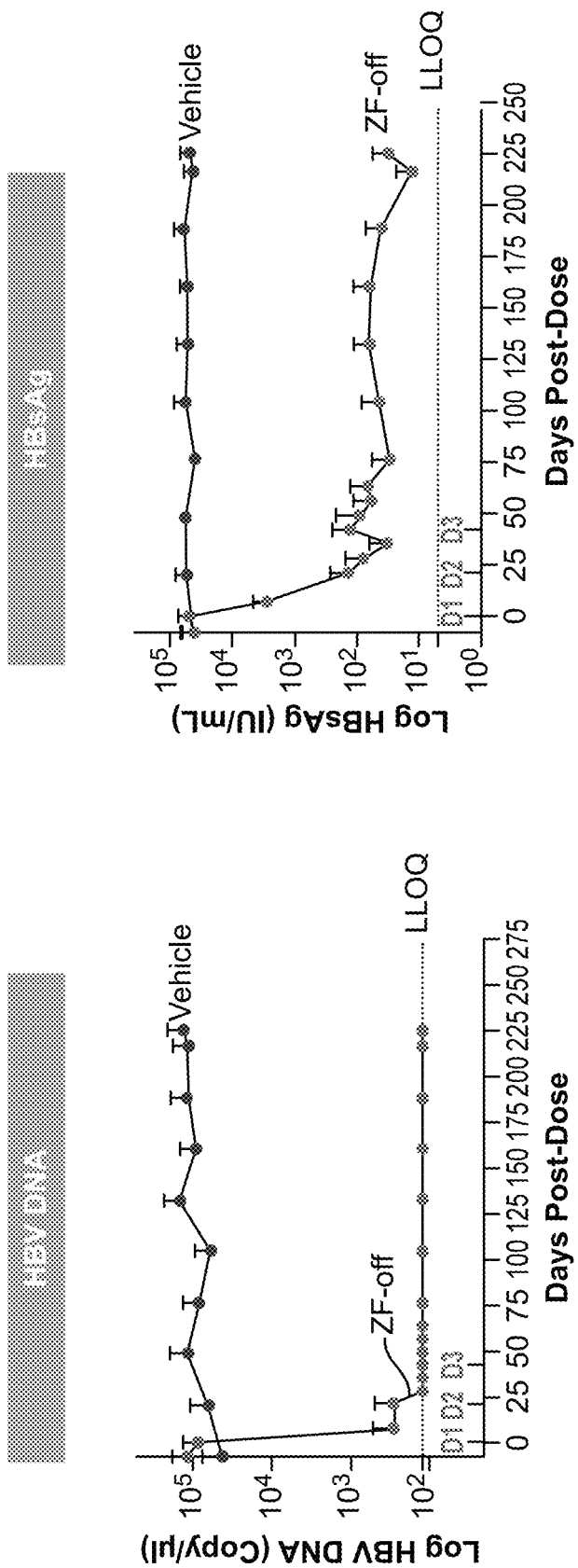
FIG. 35B shows line graphs of HBV-DNA and HBsAg in plasma in AAV mice treated with multiple doses of ZF-Off mRNA.

In another study, mice were injected with the ZF-Off construct (SEQ ID NO: 36) mRNA at 1 mg/kg for three doses: Day 0, Day 21, and Day 42. HBV DNA and HBsAg were measured from plasma over a period of 225 days. Results are shown in FIG. 35B. Results were similar to those of the previous single-dose experiment and in this experiment sustained over 225 days.

Example 17. Re-Dosing Studies for CRISPR-Off in AAV-HBV In Vivo Model

Figure 36:
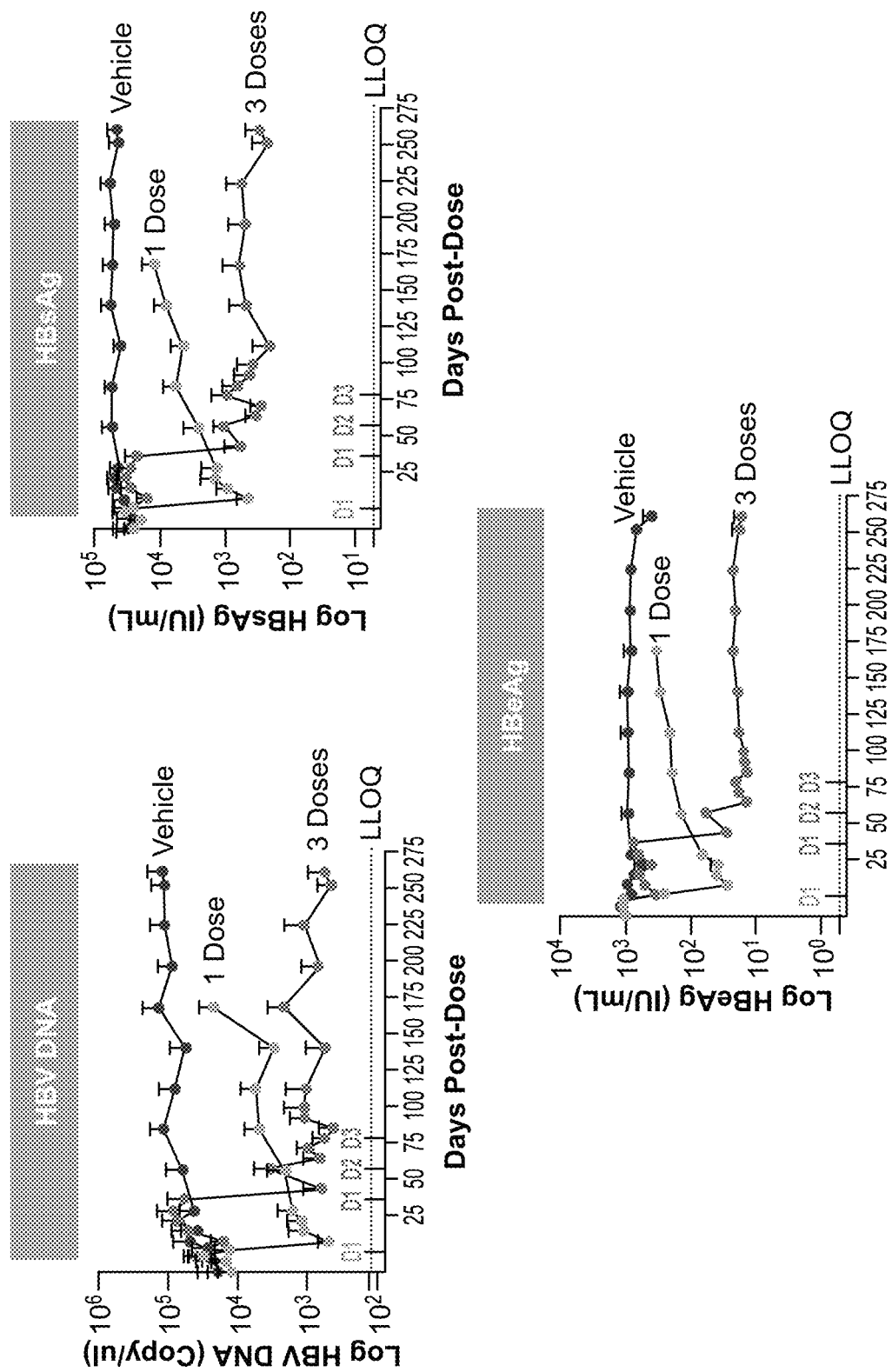
FIG. 36 shows line graphs of HBV-DNA, HBsAg, and HBeAg in plasma in AAV mice treated with single versus multiple doses of 1 mg/kg CRISPR-Off mRNA with guide RNA.

AAV-HBV mice were dosed with either a single dose or three doses, all at 1 mg/kg in LNPs, of CRISPR-Off (SEQ ID NO: 1248) mRNA with gRNA #008 at a 1:1 ratio of mRNA: guide RNA. For the single dose condition, the dose was administered at Day 0. For the three-dose condition, the doses were administered at Day 36, Day 57, and Day 78. A vehicle-only control was also administered. Plasma measurements of HBV DNA, HBsAg, and HBeAg were taken through Day 168 for the single-dose condition, and through Day 261 for both the three-dose condition and the vehicle control. Results are shown in FIG. 36. Re-dosing with CRISPR-Off further improved and sustained the durability of the modulation of these HBV biomarkers.

Figure 37:
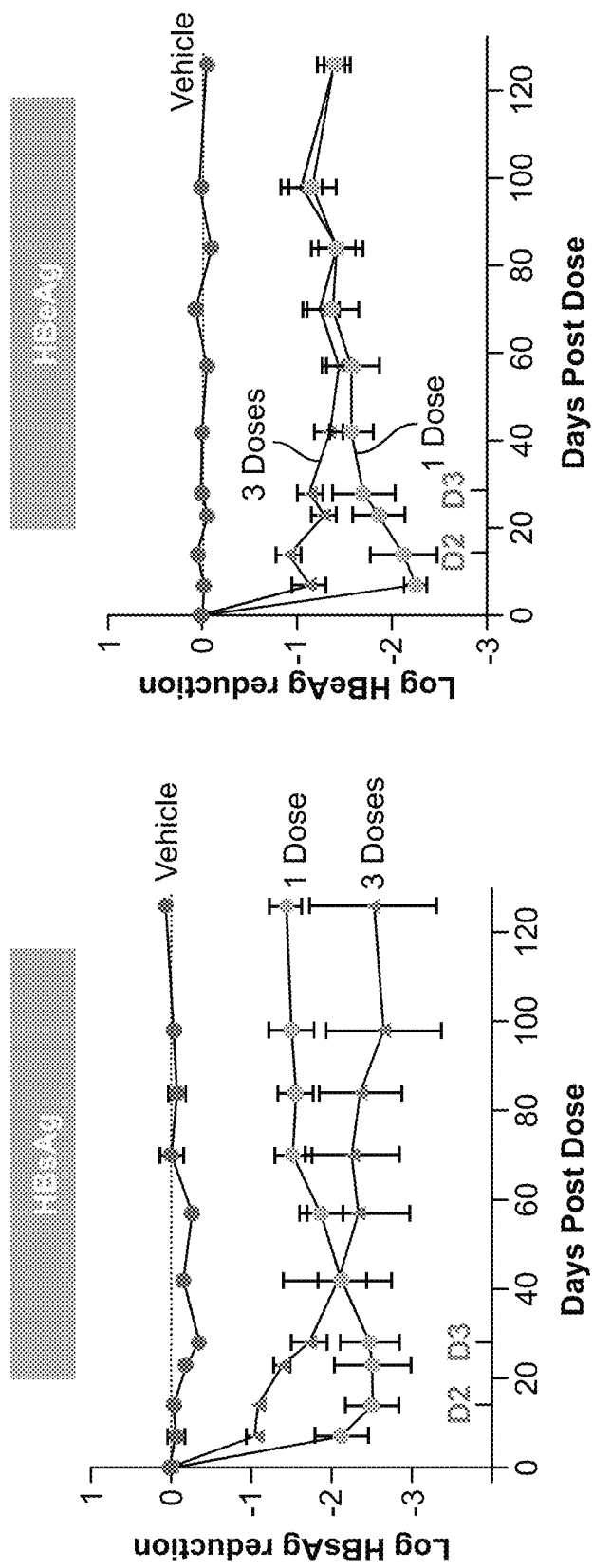
FIG. 37 shows line graphs of HBV-DNA and HBsAg in plasma in AAV mice treated with a single bolus dose of 3 mg/kg versus three doses of 1 mg/kg CRISPR-Off mRNA with guide RNA.

In another study, AAV-HBV mice were dosed with either a single dose of CRISPR-Off (SEQ ID NO: 1248) mRNA with gRNA #008 with an updated modification pattern (SEQ ID NO: 1249) (1:1 ratio mRNA: guide RNA) in LNPs at 3 mg/kg, or three doses of the same epigenetic editor, each at 1 mg/kg. Both groups received a dose at Day 0, and the three-dose group also received a dose at Day 14 and at Day 28. A vehicle-only control was also administered. HBsAg and HBeAg were measured from plasma through 126 days. Results are shown in FIG. 37. Near-additive pharmacology was demonstrated with the repeat dosing.

Figure 38:
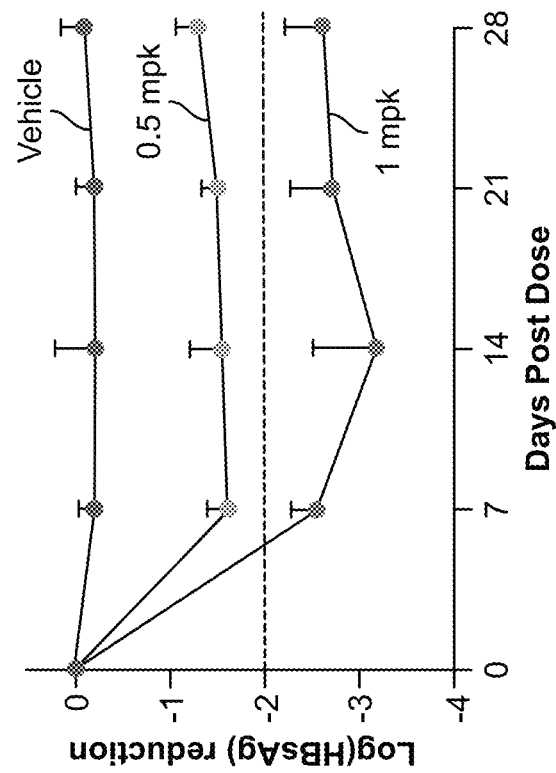
FIG. 38 shows line graphs of HBsAg in plasma in response to treatment with two different CRISPR-Off effectors (left, SEQ ID NO: 1248; right, SEQ ID NO: 1252) delivered via mRNA in combination with the same guide RNA.
Figure 38:
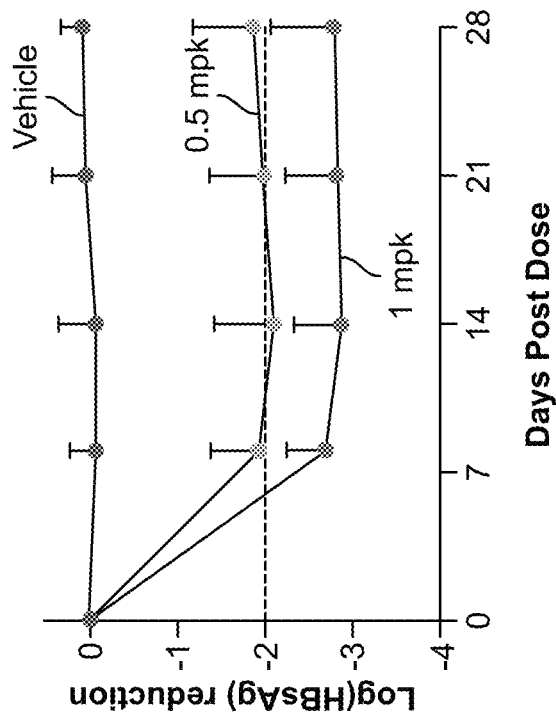

Example 18. Testing CRISPR-Off and Guide RNA Modifications in an AAV-HBV In Vivo Model AAV-HBV mice were dosed with a single dose of either CRISPR-Off (SEQ ID NO: 1248) mRNA with gRNA #008 or an updated CRISPR-Off variant (SEQ ID NO: 1252) mRNA with gRNA #008 with an updated modification pattern (SEQ ID NO: 1249), with a 1:1 ratio of mRNA to guide RNA at either 0.5 mg/kg or 1 mg/kg, delivered in LNPs. A vehicle only control was also administered. HBsAg was measured in plasma over 28 days. Results are shown in FIG. 38. The updated CRISPR-Off variant with guide RNA modifications demonstrated 1.5× potency over the previous lead epigenetic editor.

Example 19. Methylation Studies for CRISPR-Off with Various Guide RNAs

Figure 39A:
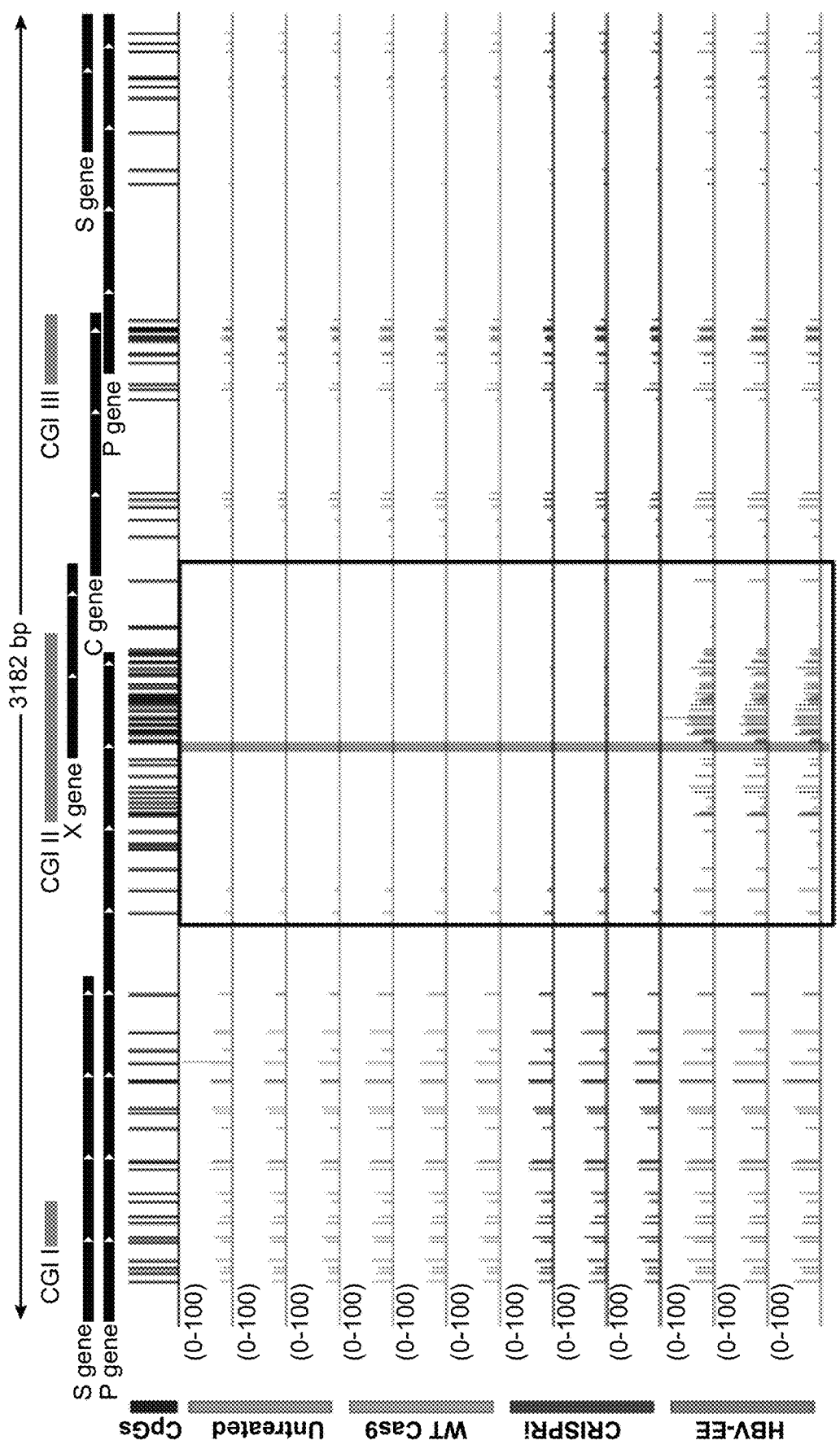
FIGS. 39A-39G show methylation of the HBV genome upon treatment with CRISPR-Off with various single guide RNAs versus wild type Cas9, CRISPRi, and non-targeting controls. The box in FIG. 39A represents the region 500 bp both upstream and downstream of the target site. The arrows indicate the position of the target sequence for the guide RNA used in the depicted experiment.
Figure 39B:
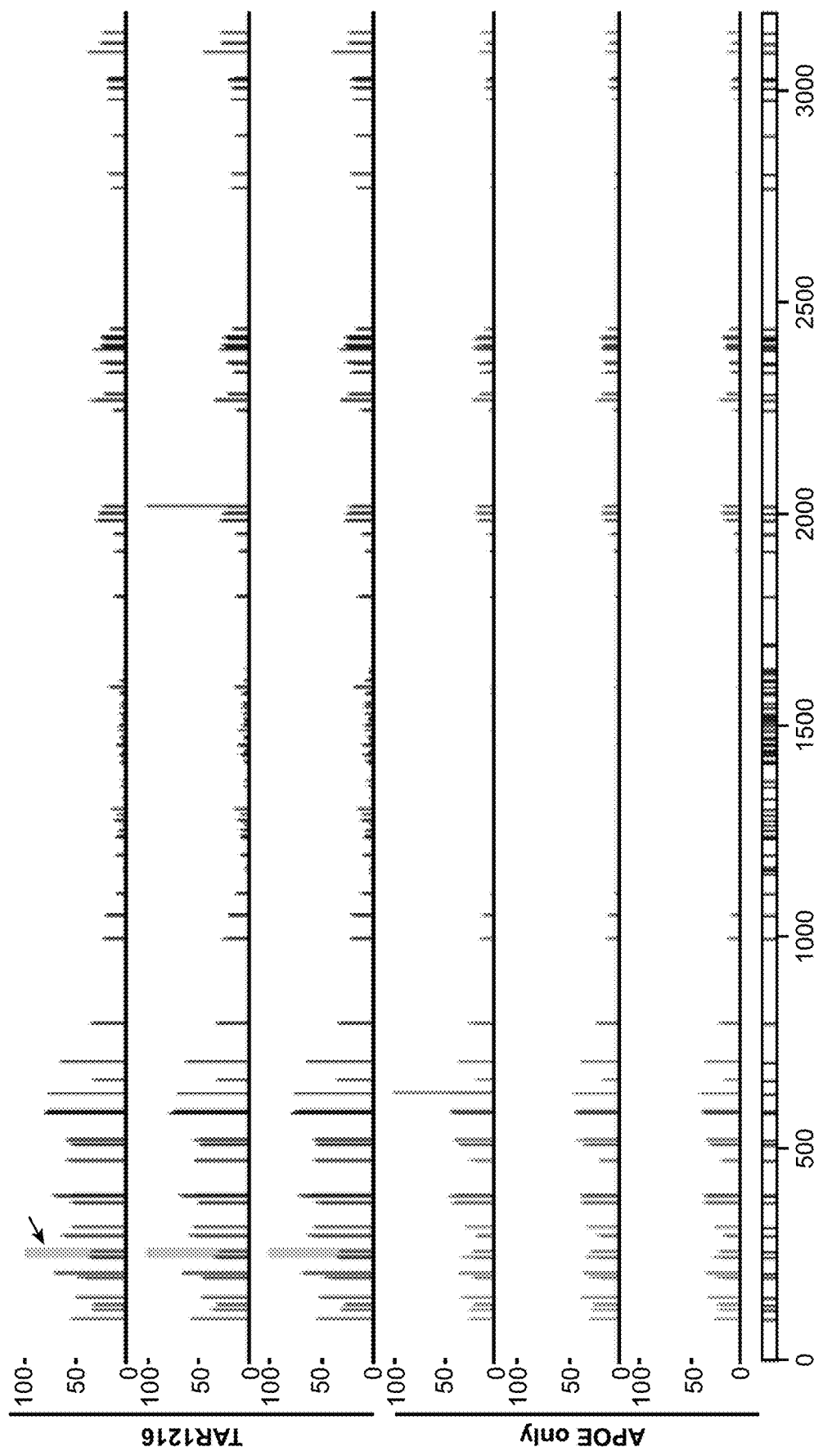
Figure 39C:
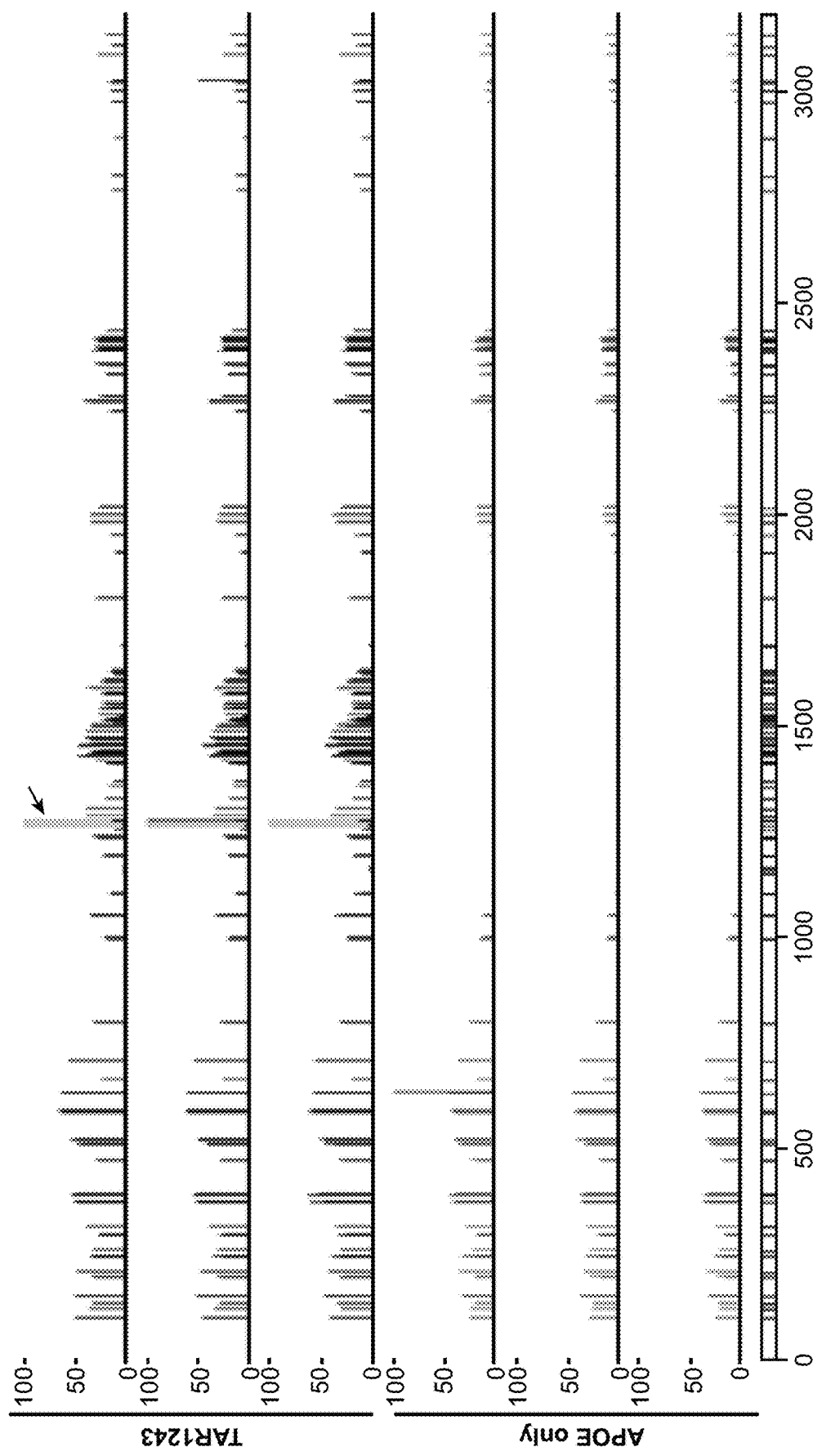
Figure 39D:
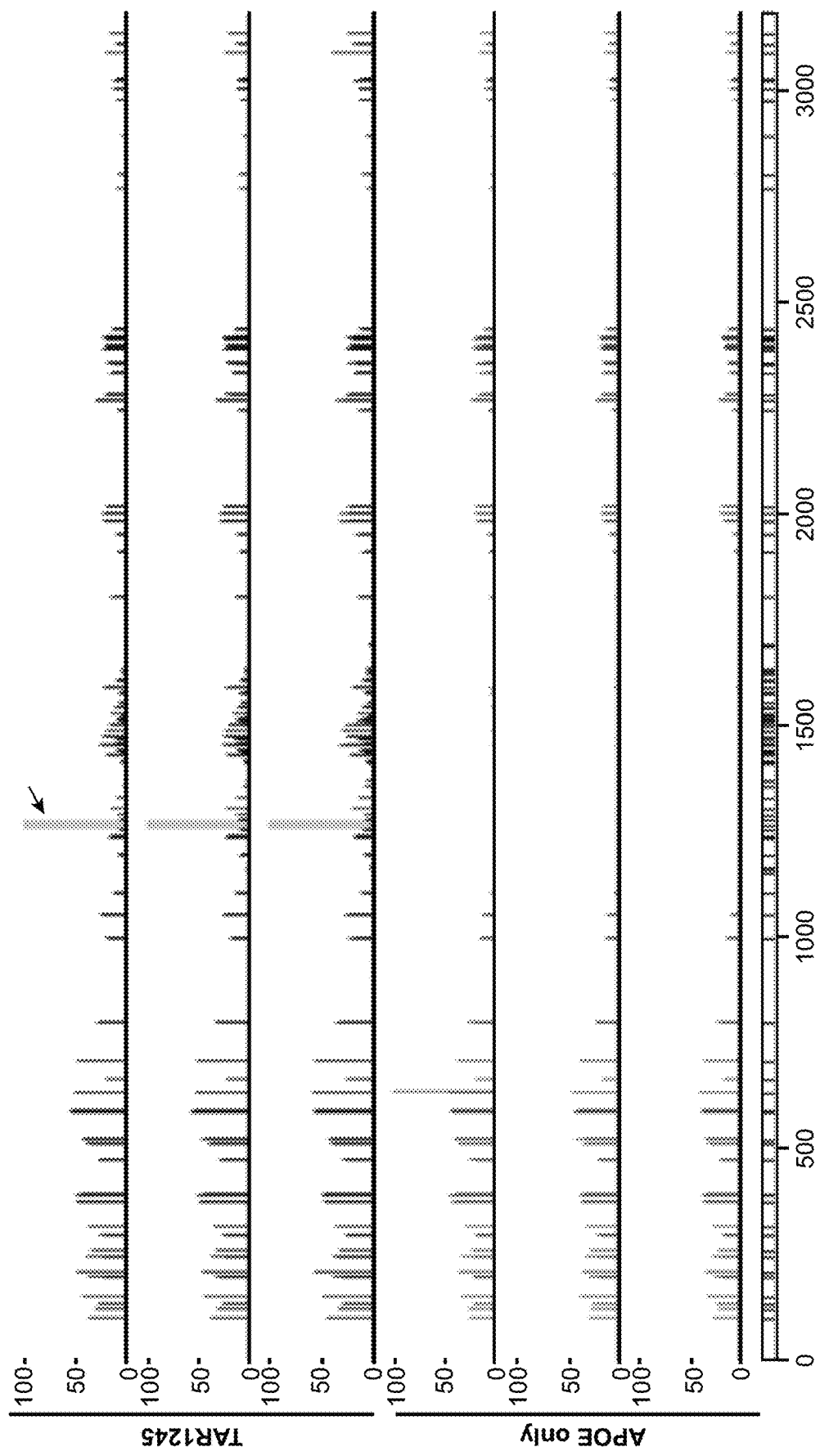
Figure 39E:
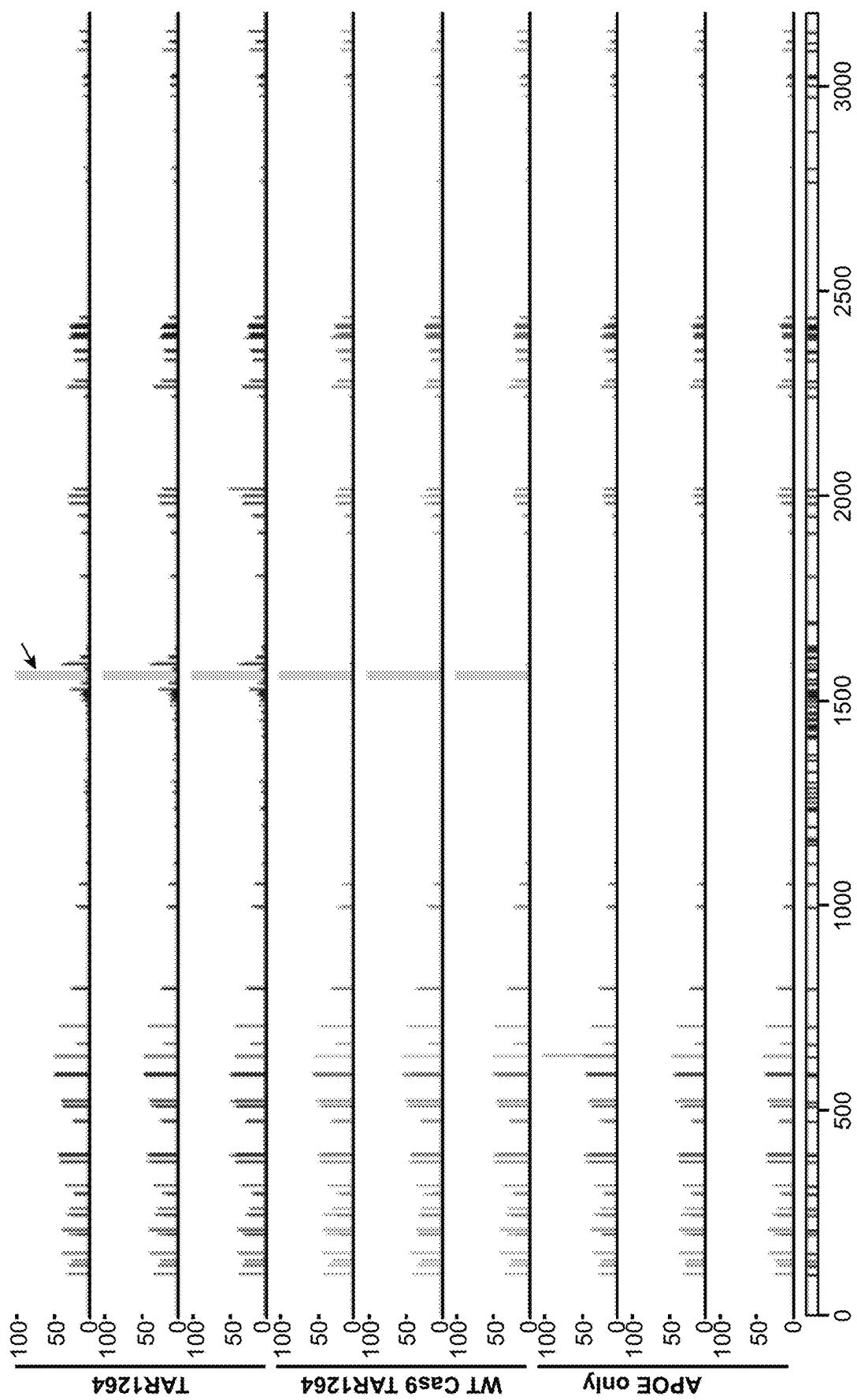
Figure 39F:
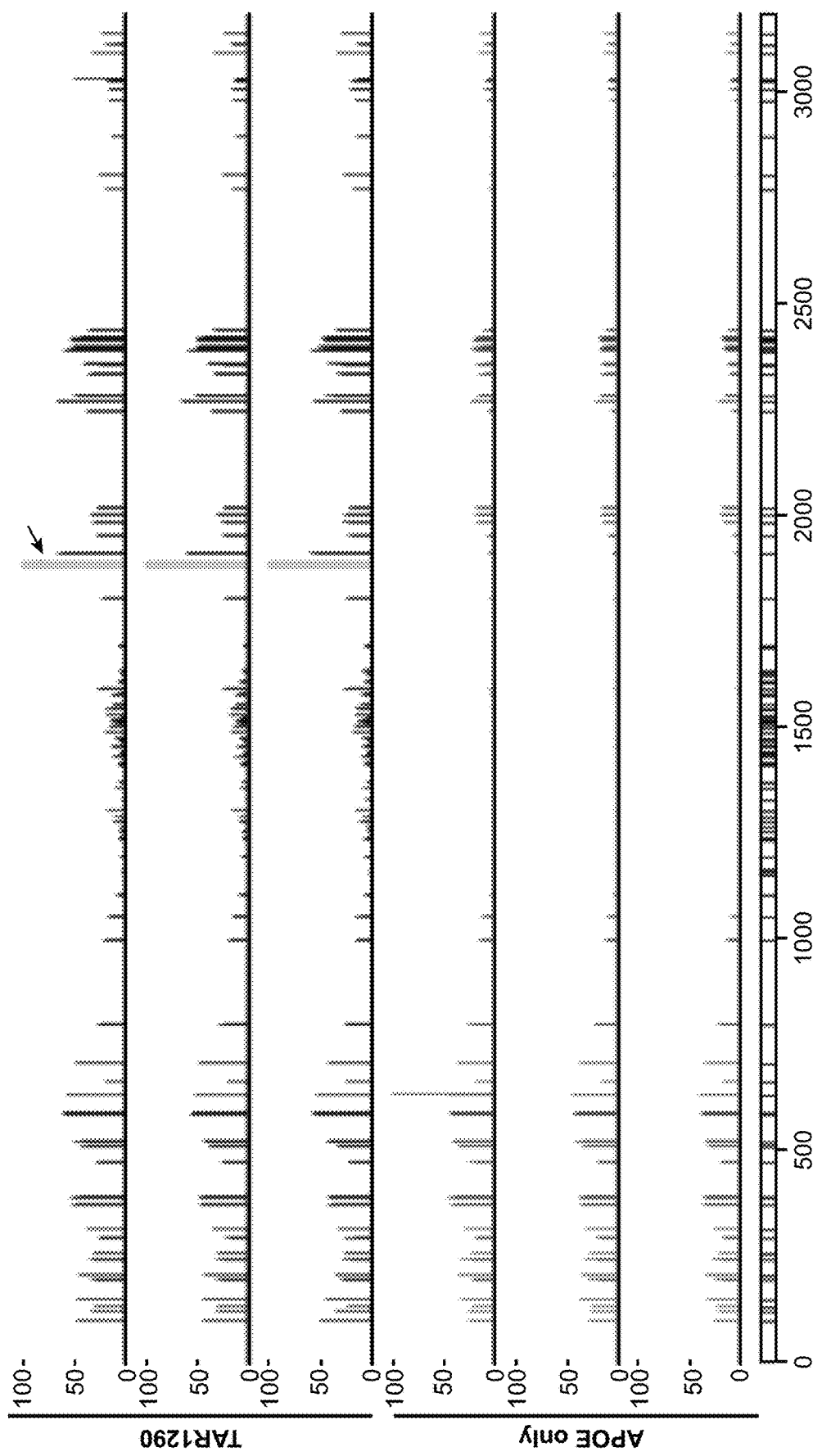
Figure 39G:
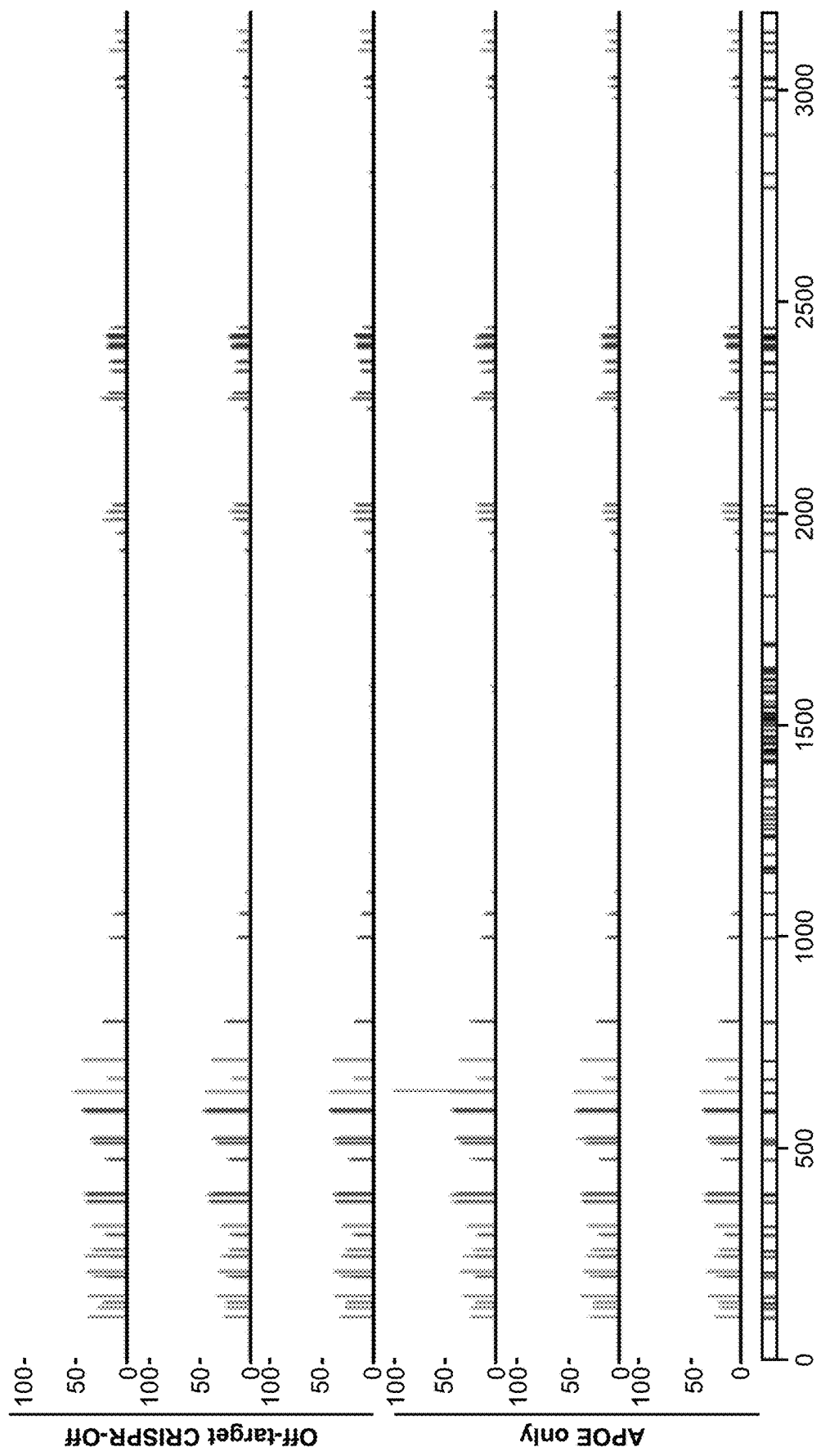

HepG2.2.15 cells were dosed at 1 nanogram (ng)/microliter (100 ng) of 1:1 CRISPR-Off (SEQ ID NO: 1248)

mRNA with various single guide RNAs in LNPs with commercial apolipoprotein E (to aid LNP entry). Methylation profiles were performed on the HBV genome samples as well as controls: for gRNA #008, untreated samples and treated with CRISPRi and wild type Cas9. For other gRNAs tested, an untreated sample (APOE only) was used as a control. Results for gRNA #008, gRNA #003, gRNA #007, gRNA #009, gRNA #011, and gRNA #015 are shown in FIGS. 39A, 39B, 39C, 39D, 39E, and 39F, respectively. A control for the application of an off-target PCSK9 guide RNA is shown in FIG. 39G.

Example 20. Specificity studies for CRISPR-Off and ZF Off

Figure 40:
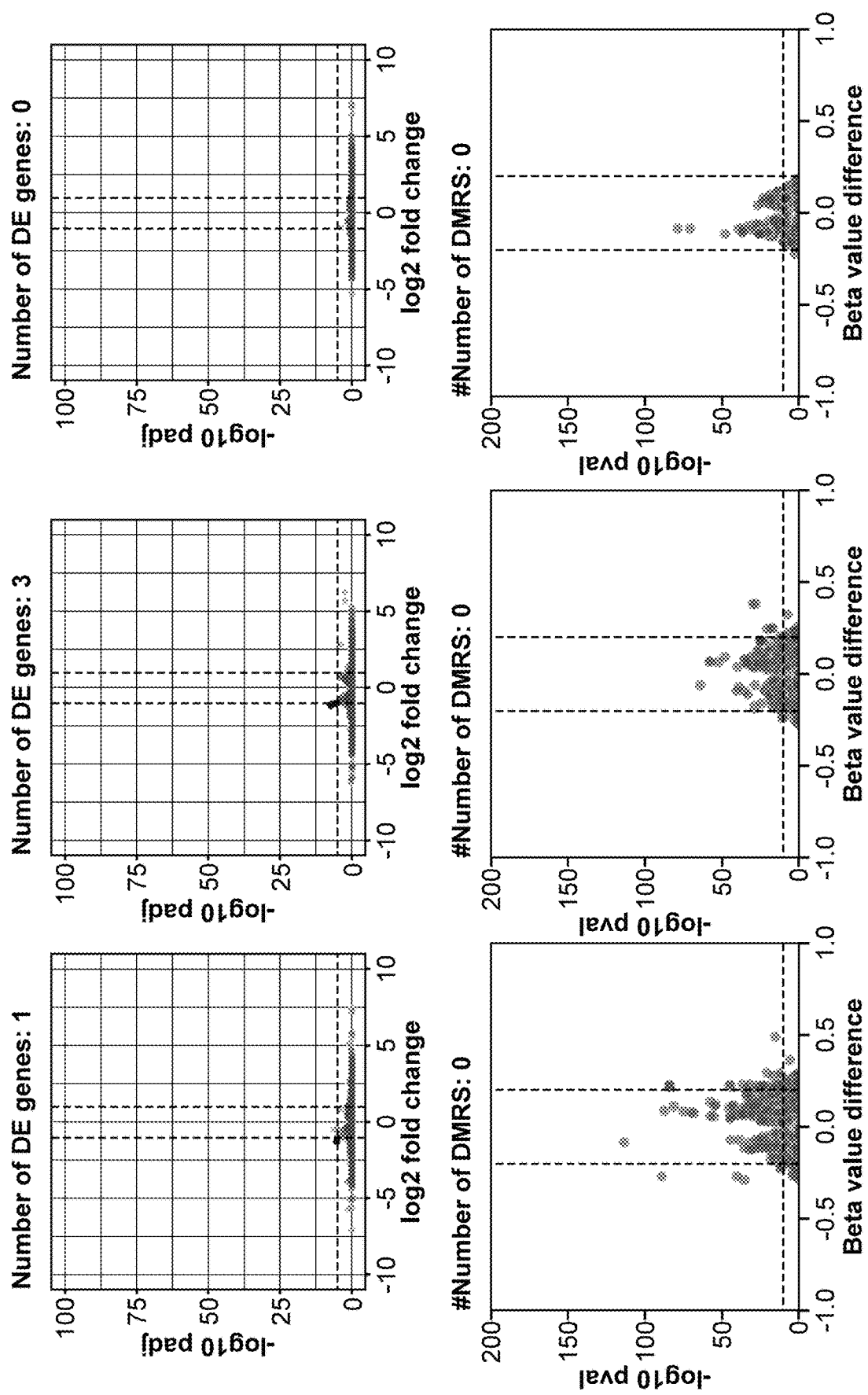
FIG. 40 shows volcano plots of RNA-Seq (top) and methylation (bottom) experiments at Day 14 after treatment in HepG2.2.15 cells treated with ZF-Off (left, SEQ ID NO: 36; center, SEQ ID NO: 73) and CRISPR-Off (right, SEQ ID NO: 1248) constructs (delivered as mRNA) targeting HBV. DE, differentially expressed. DMR: differentially methylated region.
Figure 41:
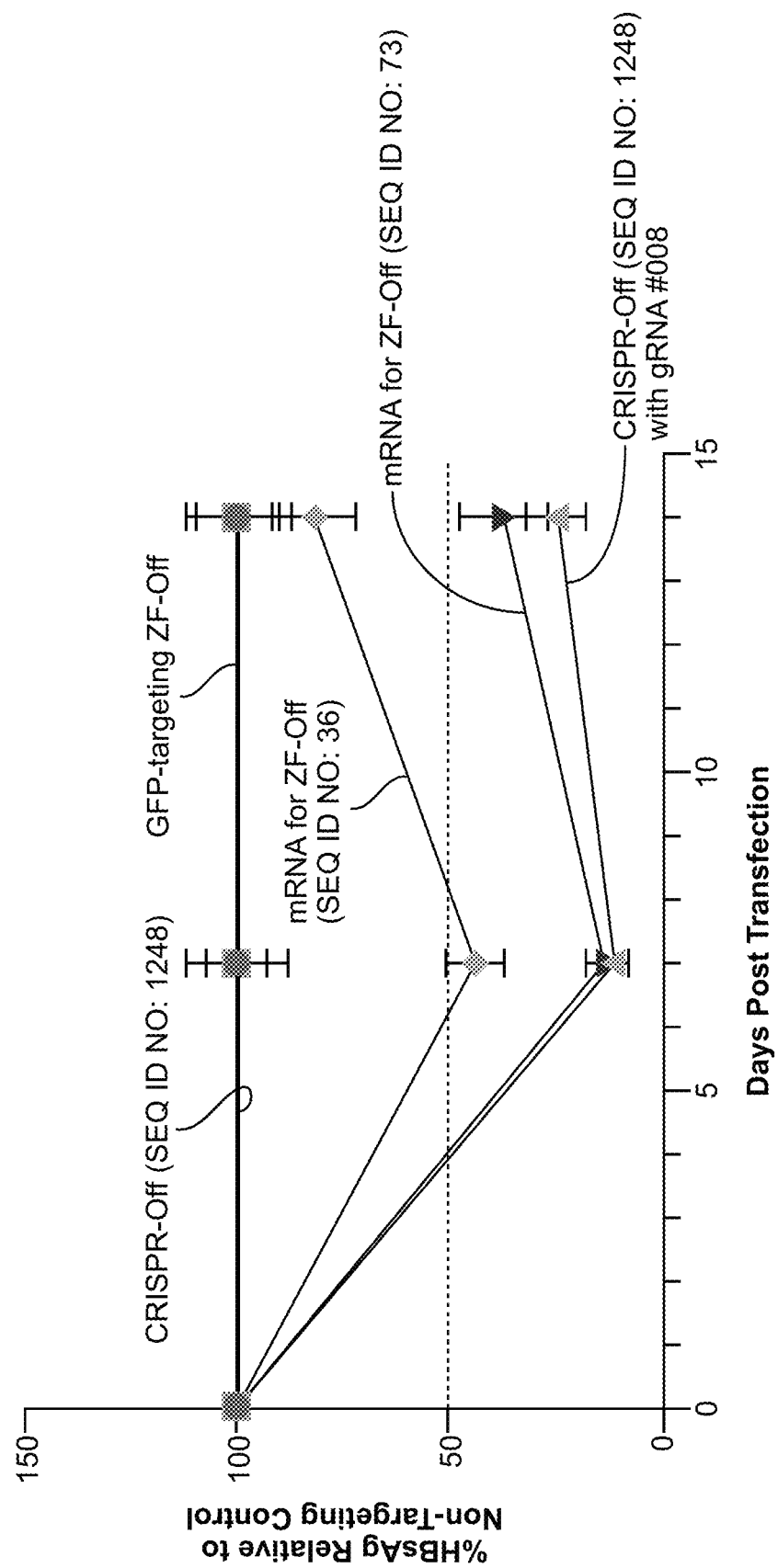
FIG. 41 shows HBsAg levels over 14 days for the cells treated for the RNA-Seq and methylation plots in FIG. 40.

HepG2.2.15 cells were transfected with either ZF-Off (SEQ ID NOs: 36 and 73) mRNA or CRISPR-Off (SEQ ID NO: 1248) mRNA with gRNA #008 in research-grade LNPs. RNA-Seq was conducted to determine differentially expressed genes (DEGs), and the Twist panel was used to determine differentially methylated regions (DMRs) at CpG-enriched sites. Differentially expressed genes (DEG) and differentially methylated regions (DMR) are defined based on literature reviews, software recommendations, sequencing depth and controls DEGs are genes that have >=2-fold change and with adjusted p-value <=1e-05. DMRs are defined as regions with a minimum of 10 CpGs, with 5× coverage, p-value of <=1e-10 and min average change in methylation (beta) >=20%. Results are shown in FIG. 40. Silencing data for same samples was also obtained. Results are shown in FIG. 41.

Example 21. Dose Response of Guide RNAs In Vitro

Figure 42:
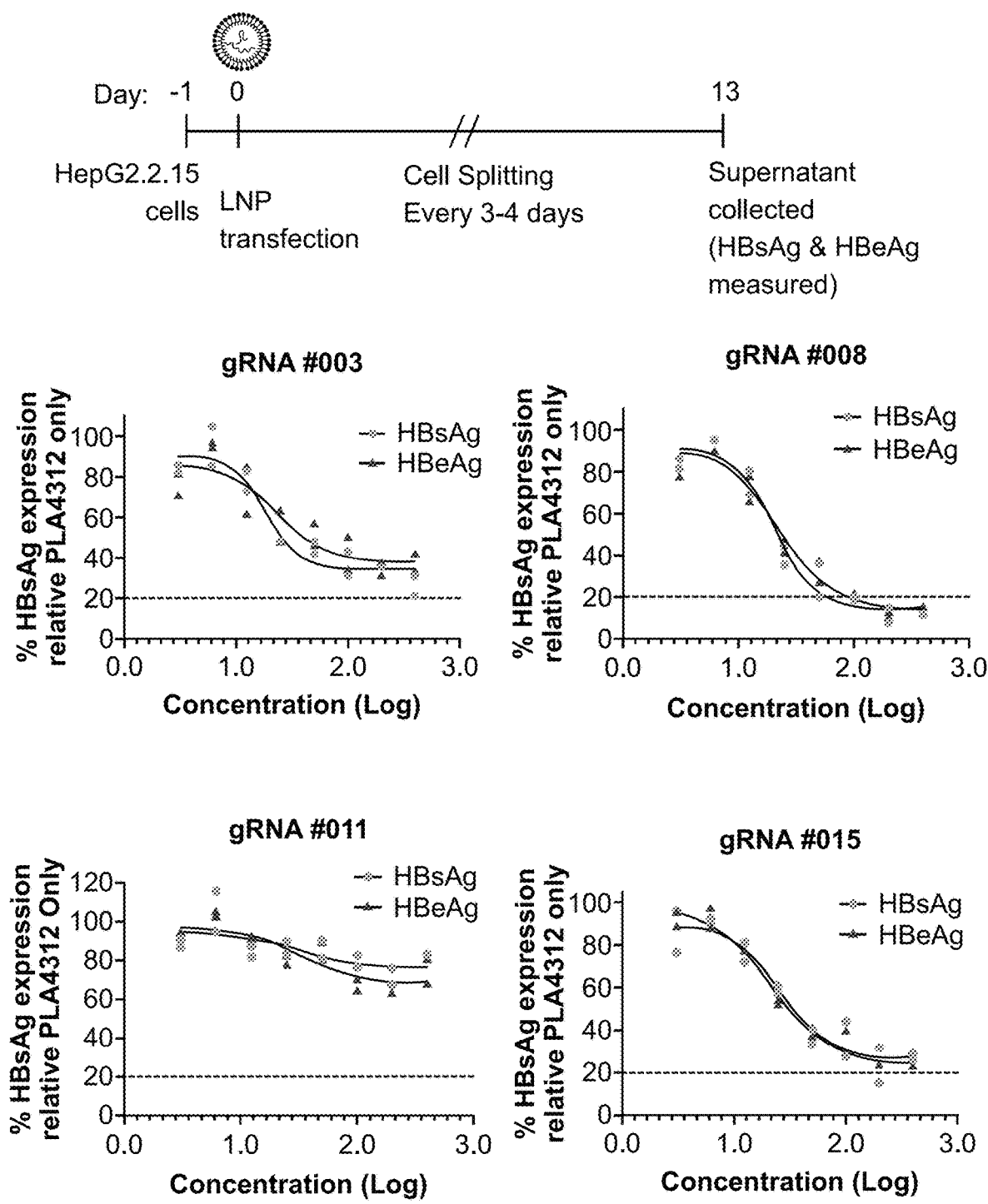
FIG. 42 shows a schematic (top) and dose curves (bottom) for CRISPR-Off dose curve experiments in HepG2.2.15 cells using various single guide RNAs and measuring HBsAg and HBeAg.

An 8-point dose-response (two-fold dilution with from 4 ng/μL (400ng) to 0.031 ng/μL (3.1 ng)) was generated using HepG2.2.15 cells treated with LNPs with CRISPR-Off effector (SEQ ID NO: 1248), delivered as mRNA, and each of four gRNAs co-formulated in a 1:1 ratio. HBsAg and HBeAg were measured over six days. Results are shown in FIG. 42.

Example 22. Dose Response of CRISPR-Off Variant In Vitro

Figure 43:
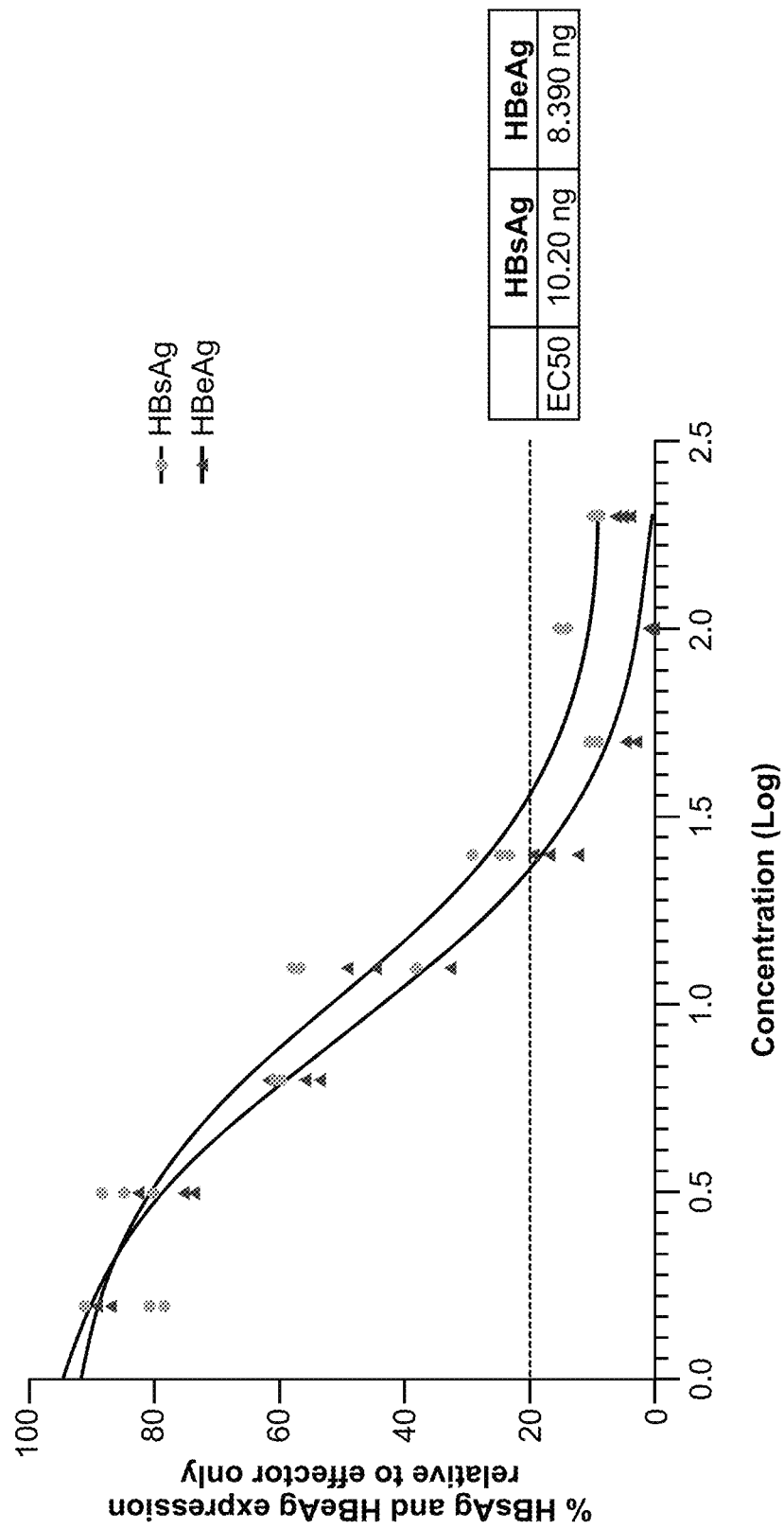
FIG. 43 shows dose curves for a CRISPR-Off variant, delivered with guide RNA, in HepG2.2.15 cells measuring HBsAg and HBeAg.

HepG2.2.15 cells transfected via Messenger Max with CRISPR-Off effector (SEQ ID NO: 1252), delivered as mRNA, and gRNA #008 with updated modification pattern (SEQ ID NO: 1249) was used to generate a 9-point dose-response (200-0.8 ng) curve. HBsAg and HBeAg were measured over 6 days. Results are shown in FIG. 43.

Example 23. Multiplexing Study in AAV-HBV and Tg-HBV Mouse Models

AAV-HBV and Tg-HBV mice are injected with a single administration at 0.5 mg/kg of one, two, three, or four guide RNAs targeting regions listed in Table 12 and Table 13 with CRISPR-Off (SEQ ID NO: 1248 or 1252) mRNA formulated in LNPs.

Amongst others, the following gRNAs are combined: (1) gRNA #008 and gRNA #011; (2) gRNA #008 and gRNA #003; (3) gRNA #008 and gRNA #015; (4) gRNA #008, gRNA #011, and gRNA #015; (6) gRNA #008, gRNA #011, and gRNA #003. Treatment with a single guide RNA, e.g., gRNA #008 or gRNA #011 serves as a positive control, and treatment with vehicle or with a non-targeting guide as a negative control.

One or more of HBV DNA, HBsAg, and HBeAg are assayed in plasma of the mice at one or more time points after administration, and the mouse liver is collected for further analysis. Combinations of multiple guides yield silencing at least as robust as treatment with single guides. In some cases, more robust silencing with multiple guides as compared to treatment with a single guide is observed.

Example 24. Testing mRNA: Guide RNA Ratios In Vivo

AAV-HBV mice are treated with CRISPR-Off effector (SEQ ID NO: 1252) mRNA with guide RNA (SEQ ID NO: 1249) in ratios including 1:1, 1:1.5, 2:1, 1:2, and 1:3 mRNA:guide RNA formulated into LNPs and administered at 0.5 mg/kg. 5 or 6 mice per study group are used. An optimized ratio of effector and guide RNA is identified that results in durable reduction of one or more HBV biomarkers, e.g., plasma level measurements of HBV DNA, HBsAg, and HBeAg of greater than 2 log below the observed control plasma level.

Example 25. Combination Treatment with Epigenetic Editor In Vivo

Tg-HBV mice are dosed with Entecavir (ETV) at 0.1 mg/kg for 14 days followed by CRISPR-Off with guide RNA at 1 mg/kg in a single intravenous dose. HBV DNA and HBsAg are measured in plasma for 112 days. HBV DNA levels drop after ETV treatment and there is slight synergism in the CRISPR-Off with guide with ETV group. After ETV withdrawal, the CRISPR-Off with guide maintains sustained reduction of DNA comparable to a group treated with CRISPR-Off and guide RNA alone. The addition of ETV does not affect HBsAg.

Example 26. Stable HBV Silencing Via Epigenetic Editing in Non-Transgenic Mouse Model of Persistent HBV Infection A non-transgenic model of persistent HBV infection (AAV-HBV) in immunocompetent mice was used, which was established by administering an adeno-associated viral vector (AAV) that contains HBV Genotype D DNA into the mice. The administration of the AAV-HBV vector resulted in expression of hepatitis B surface antigen (HBsAg), hepatitis B e antigen (HBeAg), and high levels of serum HBV DNA in the mice.

The CRISPR-off and ZF-off constructs are tested. Constructs are delivered via IV administration of mRNA/gRNA (CRISPR-Off) or mRNA (ZF-Off) formulated into a lipid nanoparticle (LNP) at 2.5 mg/kg and 0.5 mg/kg for CRISPR-Off and ZF-Off, respectively. Some constructs are formulated in LNP compositions as described in PCT/US2014/070882, US20220402862A1, and/or US20230203480A1. A subset of the mice are re-dosed at two weeks after the first dose; a second subset are re-dosed at one month after the first dose. The readouts are circulating viral DNA, HBsAg, and HBeAg, tested using mouse plasma at one or more time points (such as 7, 14, 28, and 35 days). A durable and significant reduction in the levels of one or more of HBV DNA, HBsAg, and HBeAg is observed for some constructs.

Longer-term durability is tested over three to six months using the HBV DNA, HBsAg, and HBeAg markers. Progressive and durable reduction in one or more of these markers is seen with delivery of some constructs. The mice are sacrificed and livers are collected for further analysis, and durable silencing is confirmed by at least 2 log reduction of HBsAg and HBV DNA.

Example 27: Stable HBV Silencing Via Epigenetic Editing in Transgenic Mice Expressing Viral HBV DNA A transgenic mouse model of persistent HBV infection (Tg-HBV) was used, whose genome was engineered to integrate HBV Genotype A DNA, resulting in expression of HBsAg and HBeAg, and circulating viral DNA in the mice.

The CRISPR-off and ZF-off constructs are tested. Constructs are delivered via IV administration of mRNA/gRNA (CRISPR-Off) or mRNA (ZF-Off) formulated into LNP at 2.5 mg/kg and 0.5 mg/kg for CRISPR-Off and ZF-Off, respectively. Some constructs are formulated in LNP compositions as described in US20220402862A1, and/or US20230203480A1. A subset of the mice are re-dosed at two weeks after the first dose; a second subset are re-dosed at one month after the first dose. The readouts are circulating viral DNA, HBsAg, and HBeAg, tested using mouse plasma at one or more time points (such as 7, 14, 28, and 35 days). A durable and significant reduction in the levels of one or more of HBV DNA, HBsAg, and HBeAg is observed for some constructs.

Longer-term durability is tested over three to six months using the HBV DNA, HBsAg, and HBeAg markers. Progressive and durable reduction in one or more of these markers is seen with delivery of some constructs. The mice are sacrificed and livers are collected for further analysis, and durable silencing is confirmed by at least 2 log reduction of HBsAg and HBV DNA.

SEQUENCES

The SEQ ID NOs (SEQ) of nucleotide (nt) and amino acid (aa) sequences described in the present disclosure are listed in Table 18 below.

TABLE 18

Sequence listing.

| SEQ | Description | Sequence |
|---|---|---|
| 1 | S. pyogenes WT Cas9 Sequence (nt) | ATGGATAAGAAATACTCAATAGGCTTAGATATCGGCACAAATAGCGTCGGATGG GCGGTGATCACTGATGAATATAAGGTTCCGTCTAAAAAGTTCAAGGTTCTGGGA AATACAGACCGCCACAGTATCAAAAAAAATCTTATAGGGGCTCTTTTATTTGAC AGTGGAGAGACAGCGGAAGCGACTCGTCTCAAACGGACAGCTCGTAGAAGGTAT ACACGTCGGAAGAATCGTATTTGTTATCTACAGGAGATTTTTTCAAATGAGATG GCGAAAGTAGATGATAGTTTCTTTCATCGACTTGAAGAGTCTTTTTTGGTGGAA GAAGACAAGAAGCATGAACGTCATCCTATTTTTGGAAATATAGTAGATGAAGTT GCTTATCATGAGAAATATCCAACTATCTATCATCTGCGAAAAAAATTGGTAGAT TCTACTGATAAAGCGGATTTGCGCTTAATCTATTTGGCCTTAGCGCATATGATT AAGTTTCGTGGTCATTTTTTGATTGAGGGAGATTTAAATCCTGATAATAGTGAT GTGGACAAACTATTTATCCAGTTGGTACAAACCTACAATCAATTATTTGAAGAA AACCCTATTAACGCAAGTGGAGTAGATGCTAAAGCGATTCTTTCTGCACGATTG AGTAAATCAAGACGATTAGAAAATCTCATTGCTCAGCTCCCCGGTGAGAAGAAA AATGGCTTATTTGGGAATCTCATTGCTTTGTCATTGGGTTTGACCCCTAATTTT AAATCAAATTTTGATTTGGCAGAAGATGCTAAATTACAGCTTTCAAAAGATACT TACGATGATGATTTAGATAATTTATTGGCGCAAATTGGAGATCAATATGCTGAT TTGTTTTTGGCAGCTAAGAATTTATCAGATGCTATTTTACTTTCAGATATCCTA AGAGTAAATACTGAAATAACTAAGGCTCCCCTATCAGCTTCAATGATTAAACGC TACGATGAACATCATCAAGACTTGACTCTTTTAAAAGCTTTAGTTCGACAACAA CTTCCAGAAAAGTATAAAGAAATCTTTTTTGATCAATCAAAAAACGGATATGCA GGTTATATTGATGGGGGAGCTAGCCAAGAAGAATTTTATAAATTTATCAAACCA ATTTTAGAAAAAATGGATGGTACTGAGGAATTATTGGTGAAACTAAATCGTGAA GATTTGCTGCGCAAGCAACGGACCTTTGACAACGGCTCTATTCCCCATCAAATT CACTTGGGTGAGCTGCATGCTATTTTGAGAAGACAAGAAGACTTTTATCCATTT TTAAAAGACAATCGTGAGAAGATTGAAAAAATCTTGACTTTTCGAATTCCTTAT TATGTTGGTCCATTGGCGCGTGGCAATAGTCGTTTTGCATGGATGACTCGGAAG TCTGAAGAAACAATTACCCCATGGAATTTTGAAGAAGTTGTCGATAAAGGTGCT TCAGCTCAATCATTTATTGAACGCATGACAAACTTTGATAAAAATCTTCCAAAT GAAAAAGTACTACCAAAACATAGTTTGCTTTATGAGTATTTTACGGTTTATAAC GAATTGACAAAGGTCAAATATGTTACTGAAGGAATGCGAAAACCAGCATTTCTT TCAGGTGAACAGAAGAAAGCCATTGTTGATTTACTCTTCAAAACAAATCGAAAA GTAACCGTTAAGCAATTAAAAGAAGATTATTTCAAAAAAATAGAATGTTTTGAT AGTGTTGAAATTTCAGGAGTTGAAGATAGATTTAATGCTTCATTAGGTACCTAC CATGATTTGCTAAAAATTATTAAAGATAAAGATTTTTTGGATAATGAAGAAAAT GAAGATATCTTAGAGGATATTGTTTTAACATTGACCTTATTTGAAGATAGGGAG ATGATTGAGGAAAGACTTAAAACATATGCTCACCTCTTTGATGATAAGGTGATG AAACAGCTTAAACGTCGCCGTTATACTGGTTGGGGACGTTTGTCTCGAAAATTG ATTAATGGTATTAGGGATAAGCAATCTGGCAAAACAATATTAGATTTTTTGAAA TCAGATGGTTTTGCCAATCGCAATTTTATGCAGCTGATCCATGATGATAGTTTG ACATTTAAGAAGACATTCAAAAAGCACAAGTGTCTGGACAAGGCGATAGTTTA CATGAACATATTGCAAATTTAGCTGGTAGCCCTGCTATTAAAAAAGGTATTTTA CAGACTGTAAAAGTTGTTGATGAATTGGTCAAAGTAATGGGGCGGCATAAGCCA GAAAATATCGTTATTGAAATGGCACGTGAAAATCAGACAACTCAAAAGGGCCAG AAAAATTCGCGAGAGCGTATGAAACGAATCGAAGAAGGTATCAAAGAATTAGGA AGTCAGATTCTTAAAGAGCATCCTGTTGAAAATACTCAATTGCAAATGAAAAG CTCTATCTCTATTATCTCCAAAATGGAAGAGACATGTATGTGGACCAAGAATTA GATATTAATCGTTTAAGTGATTATGATGTCGATCACATTGTTCCACAAAGTTTC CTTAAAGACGATTCAATAGACAATAAGGTCTTAACGCGTTCTGATAAAAATCGT |

TABLE 18-continued

Sequence listing.

| SEQ | Description | Sequence |
|---|---|---|
|  |  | GGTAAATCGGATAACGTTCCAAGTGAAGAAGTAGTCAAAAAGATGAAAAACTAT<br>TGGAGACAACTTCTAAACGCCAAGTTAATCACTCAACGTAAGTTTGATAATTTA<br>ACGAAAGCTGAACGTGGAGGTTTGAGTGAACTTGATAAAGCTGGTTTTATCAAA<br>CGCCAATTGGTTGAAACTCGCCAAATCACTAAGCATGTGGCACAAATTTTGGAT<br>AGTCGCATGAATACTAAATACGATGAAAATGATAAACTTATTCGAGAGGTTAAA<br>GTGATTACCTTAAAATCTAAATTAGTTTCTGACTTCCGAAAAGATTTCCAATTC<br>TATAAAGTACGTGAGATTAACAATTACCATCATGCCCATGATGCGTATCTAAAT<br>GCCGTCGTTGGAACTGCTTTGATTAAGAAATATCCAAAACTTGAATCGGAGTTT<br>GTCTATGGTGATTATAAAGTTTATGATGTTCGTAAAATGATTGCTAAGTCTGAG<br>CAAGAAATAGGCAAAGCAACCGCAAAATATTTCTTTTACTCTAATATCATGAAC<br>TTCTTCAAAACAGAAATTACACTTGCAAATGGAGAGATTCGCAAACGCCCTCTA<br>ATCGAAACTAATGGGGAAACTGGAGAAATTGTCTGGGATAAAGGGCGAGATTTT<br>GCCACAGTGCGCAAAGTATTGTCCATGCCCCAAGTCAATATTGTCAAGAAAACA<br>GAAGTACAGACAGGCGGATTCTCCAAGGAGTCAATTTTACCAAAAAGAAATTCG<br>GACAAGCTTATTGCTCGTAAAAAAGACTGGGATCCAAAAAAATATGGTGGTTTT<br>GATAGTCCAACGGTAGCTTATTCAGTCCTAGTGGTTGCTAAGGTGGAAAAAGGG<br>AAATCGAAGAAGTTAAAATCCGTTAAAGAGTTACTAGGGATCACAATTATGGAA<br>AGAAGTTCCTTTGAAAAAAATCCGATTGACTTTTTAGAAGCTAAAGGATATAAG<br>GAAGTTAAAAAGACTTAATCATTAAACTACCTAAATATAGTCTTTTTGAGTTA<br>GAAAACGGTCGTAAACGGATGCTGGCTAGTGCCGGAGAATTACAAAAAGGAAAT<br>GAGCTGGCTCTGCCAAGCAAATATGTGAATTTTTTATATTTAGCTAGTCATTAT<br>GAAAAGTTGAAGGGTAGTCCAGAAGATAACGAACAAAAACAATTGTTTGTGGAG<br>CAGCATAAGCATTATTTAGATGAGATTATTGAGCAAATCAGTGAATTTTCTAAG<br>CGTGTTATTTTAGCAGATGCCAATTTAGATAAAGTTCTTAGTGCATATAACAAA<br>CATAGAGACAAACCAATACGTGAACAAGCAGAAAATATTATTCATTTATTTACG<br>TTGACGAATCTTGGAGCTCCCGCTGCTTTTAAATATTTTGATACAACAATTGAT<br>CGTAAACGATATACGTCTACAAAAGAAGTTTTAGATGCCACTCTTATCCATCAA<br>TCCATCACTGGTCTTTATGAAACACGCATTGATTTGAGTCAGCTAGGAGGTGAC<br>TGA |
| 2 | S. pyogenes WT<br>Cas9 Sequence<br>(aa) | MDKKYSIGLDIGTNSVGWAVITDEYKVPSKKFKVLGNTDRHSIKKNLIGALLED<br>SGETAEATRLKRTARRRYTRRKNRICYLQEIFSNEMAKVDDSFFHRLEESELVE<br>EDKKHERHPIFGNIVDEVAYHEKYPTIYHLRKKLVDSTDKADLRLIYLALAHMI<br>KFRGHFLIEGDLNPDNSDVDKLFIQLVQTYNQLFEENPINASGVDAKAILSARL<br>SKSRRLENLIAQLPGEKKNGLFGNLIALSLGLTPNFKSNFDLAEDAKLQLSKDT<br>YDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIKP<br>ILEKMDGTEELLVKLNREDLLRKQRTEDNGSIPHQIHLGELHAILRRQEDFYPE<br>LKDNREKIEKILTFRIPYYVGPLARGNSRFAWMTRKSEETITPWNFEEVVDKGA<br>SAQSFIERMTNFDKNLPNEKVLPKHSLLYEYFTVYNELTKVKYVTEGMRKPAFL<br>SGEQKKAIVDLLFKTNRKVTVKQLKEDYFKKIECFDSVEISGVEDRFNASLGTY<br>HDLLKIIKDKDELDNEENEDILEDIVLTLTLFEDREMIEERLKTYAHLEDDKVM<br>KQLKRRRYTGWGRLSRKLINGIRDKQSGKTILDFLKSDGFANRNFMQLIHDDSL<br>TFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEK<br>LYLYYLQNGRDMYVDQELDINRLSDYDVDHIVPQSFLKDDSIDNKVLTRSDKNR<br>GKSDNVPSEEVVKKMKNYWRQLLNAKLITQRKFDNLTKAERGGLSELDKAGFIK<br>RQLVETRQITKHVAQILDSRMNTKYDENDKLIREVKVITLKSKLVSDERKDFQF<br>YKVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGGE<br>DSPTVAYSVLVVAKVEKGKSKKLKSVKELLGITIMERSSFEKNPIDELEAKGYK<br>EVKKDLIIKLPKYSLFELENGRKRMLASAGELQKGNELALPSKYVNFLYLASHY<br>EKLKGSPEDNEQKQLFVEQHKHYLDEIIEQISEFSKRVILADANLDKVLSAYNK<br>HRDKPIREQAENIIHLFTLTNLGAPAAFKYFDTTIDRKRYTSTKEVLDATLIHQ<br>SITGLYETRIDLSQLGGD |
| 3 | SaCas9 | MKRNYILGLDIGITSVGYGIIDYETRDVIDAGVRLFKEANVENNEGRRSKRGAR<br>RLKRRRHRIQRVKKLLFDYNLLTDHSELSGINPYEARVKGLSQKLSEEEFSAA<br>LLHLAKRRGVHNVNEVEEDTGNELSTKEQISRNSKALEEKYVAELQLERLKKDG<br>EVRGSINRFKTSDYVKEAKQLLKVQKAYHQLDQSFIDTYIDLLETRRTYYEGPG<br>EGSPFGWKDIKEWYEMLMGHCTYFPEELRSVKYAYNADLYNALNDLNNLVITRD<br>ENEKLEYYEKFQIIENVFKQKKKPTLKQIAKEILVNEEDIKGYRVTSTGKPEFT<br>NLKVYHDIKDITARKEIIENAELLDQIAKILTIYQSSEDIQEELTNLNSELTQE<br>EIEQISNLKGYTGTHNLSLKAINLILDELWHTNDNQIAIFNRLKLVPKKVDLSQ<br>QKEIPTTLVDDFILSPVVKRSFIQSIKVINAIIKKYGLPNDIIIELAREKNSKD<br>AQKMINEMQKRNRQTNERIEEIIRTTGKENAKYLIEKIKLHDMQEGKCLYSLEA<br>IPLEDLLNNPFNYEVDHIIPRSVSEDNSFNNKVLVKQEENSKKGNRTPFQYLSS<br>SDSKISYETFKKHILNLAKGKGRISKTKKEYLLEERDINRESVQKDFINRNLVD<br>TRYATRGLMNLLRSYFRVNNLDVKVKSINGGFTSFLRRKWKFKKERNKGYKHHA<br>EDALIIANADFIFKEWKKLDKAKKVMENQMFEEKQAESMPEIETEQEYKEIFIT<br>PHQIKHIKDFKDYKYSHRVDKKPNRELINDTLYSTRKDDKGNTLIVNNLNGLYD<br>KDNDKLKKLINKSPEKLLMYHHDPQTYQKLKLIMEQYGDEKNPLYKYYEETGNY<br>LTKYSKKDNGPVIKKIKYYGNKLNAHLDITDDYPNSRNKVVKLSLKPYREDVYL |

TABLE 18-continued

Sequence listing.

| SEQ | Description | Sequence |
|---|---|---|
|  |  | DNGVYKFVTVKNLDVIKKENYYEVNSKCYEEAKKLKKISNQAEFIASFYNNDLI<br>KINGELYRVIGVNNDLLNRIEVNMIDITYREYLENMNDKRPPRIIKTIASKTQS<br>IKKYSTDILGNLYEVKSKKHPQIIKKG |
| 4 | F. novicida WT Cpf1 | MSIYQEFVNKYSLSKTLRFELIPQGKTLENIKARGLILDDEKRAKDYKKAKQII<br>DKYHQFFIEEILSSVCISEDLLQNYSDVYFKLKKSDDDNLQKDEKSAKDTIKKQ<br>ISEYIKDSEKFKNLENQNLIDAKKGQESDLILWLKQSKDNGIELFKANSDITDI<br>DEALEIIKSFKGWTTYFKGFHENRKNVYSSNDIPTSIIYRIVDDNLPKFLENKA<br>KYESLKDKAPEAINYEQIKKDLAEELTFDIDYKTSEVNQRVESLDEVFEIANEN<br>NYLNQSGITKENTIIGGKFVNGENTKRKGINEYINLYSQQINDKTLKKYKMSVL<br>FKQILSDTESKSFVIDKLEDDSDVVTTMQSFYEQIAAFKTVEEKSIKETLSLLE<br>DDLKAQKLDLSKIYFKNDKSLTDLSQQVEDDYSVIGTAVLEYITQQIAPKNLDN<br>PSKKEQELIAKKTEKAKYLSLETIKLALEEENKHRDIDKQCRFEEILANFAAIP<br>MIFDEIAQNKDNLAQISIKYQNQGKKDLLQASAEDDVKAIKDLLDQTNNLLHKL<br>KIFHISQSEDKANILDKDEHFYLVFEECYFELANIVPLYNKIRNYITQKPYSDE<br>KFKLNFENSTLANGWDKNKEPDNTAILFIKDDKYYLGVMNKKNNKIFDDKAIKE<br>NKGEGYKKIVYKLLPGANKMLPKVFFSAKSIKFYNPSEDILRIRNHSTHTKNGS<br>PQKGYEKFEFNIEDCRKFIDFYKQSISKHPEWKDFGFRESDTQRYNSIDEFYRE<br>VENQGYKLTFENISESYIDSVVNQGKLYLFQIYNKDFSAYSKGRPNLHTLYWKA<br>LEDERNLQDVVYKLNGEAELFYRKQSIPKKITHPAKEAIANKNKDNPKKESVFE<br>YDLIKDKRFTEDKFFFHCPITINFKSSGANKENDEINLLLKEKANDVHILSIDR<br>GERHLAYYTLVDGKGNIIKQDTENIIGNDRMKTNYHDKLAAIEKDRDSARKDWK<br>KINNIKEMKEGYLSQVVHEIAKLVIEYNAIVVFEDLNFGEKRGREKVEKQVYQK<br>LEKMLIEKLNYLVFKDNEFDKTGGVLRAYQLTAPFETFKKMGKQTGIIYYVPAG<br>FTSKICPVTGFVNQLYPKYESVSKSQEFFSKFDKICYNLDKGYFEFSFDYKNFG<br>DKAAKGKWTIASFGSRLINFRNSDKNHNWDTREVYPTKELEKLLKDYSIEYGHG<br>ECIKAAICGESDKKFFAKLTSVLNTILQMRNSKTGTELDYLISPVADVNGNEED<br>SRQAPKNMPQDADANGAYHIGLKGLMLLGRIKNNQEGKKLNLVIKNEEYFEFVQ<br>NRNN |
| 5 | CasX | MEKRINKIRKKLSADNATKPVSRSGPMKTLLVRVMTDDLKKRLEKRRKKPEVMP<br>QVISNNAANNLRMLLDDYTKMKEAILQVYWQEFKDDHVGLMCKFAQPASKKIDQ<br>NKLKPEMDEKGNLTTAGFACSQCGQPLFVYKLEQVSEKGKAYTNYFGRCNVAEH<br>EKLILLAQLKPEKDSDEAVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPVVERRENEVDWWNTINEVKKLIDAKRDMGRVFWSGVTAEKRNTILE<br>GYNYLPNENDHKKREGSLENPKKPAKRQFGDLLLYLEKKYAGDWGKVEDEAWER<br>IDKKIAGLTSHIEREEEARNAEDAQSKAVLTDWLRAKASFVLERLKEMDEKEFYA<br>CEIQLQKWYGDLRGNPFAVEAENRVVDISGFSIGSDGHSIQYRNLLAWKYLENG<br>KREFYLLMNYGKKGRIRFTDGTDIKKSGKWQGLLYGGGKAKVIDLTEDPDDEQL<br>IILPLAFGTRQGREFIWNDLLSLETGLIKLANGRVIEKTIYNKKIGRDEPALFV<br>ALTFERREVVDPSNIKPVNLIGVDRGENIPAVIALTDPEGCPLPEFKDSSGGPT<br>DILRIGEGYKEKQRAIQAAKEVEQRRAGGYSRKFASKSRNLADDMVRNSARDLE<br>YHAVTHDAVLVFENLSRGFGRQGKRTEMTERQYTKMEDWLTAKLAYEGLTSKTY<br>LSKTLAQYTSKTCSNCGFTITTADYDGMLVRLKKTSDGWATTLNNKELKAEGQI<br>TYYNRYKRQTVEKELSAELDRLSEESGNNDISKWTKGRRDEALFLLKKRESHRP<br>VQEQFVCLDCGHEVHADEQAALNIARSWLFLNSNSTEFKSYKSGKQPFVGAWQA<br>FYKRRLKEVWKPNA |
| 6 | CasY | MRKKLFKGYILHNKRLVYTGKAAIRSIKYPLVAPNKTALNNLSEKIIYDYEHLF<br>GPLNVASYARNSNRYSLVDFWIDSLRAGVIWQSKSTSLIDLISKLEGSKSPSEK<br>IFEQIDFELKNKLDKEQFKDIILLNTGIRSSSNVRSLRGRFLKCFKEEFRDTEE<br>VIACVDKWSKDLIVEGKSILVSKQFLYWEEEFGIKIFPHFKDNHDLPKLTFFVE<br>PSLEFSPHLPLANCLERLKKEDISRESLLGLDNNESAFSNYENELENLLSRGEI<br>KKIVTAVLAVSKSWENEPELEKRLHELSEKAKLLGYPKLTSSWADYRMIIGGKI<br>KSWHSNYTEQLIKVREDLKKHQIALDKLQEDLKKVVDSSLREQIEAQREALLPL<br>LDTMLKEKDESDDLELYRFILSDEKSLINGSYQRYIQTEEERKEDRDVTKKYKD<br>LYSNLRNIPREFGESKKEQENKFINKSLPTIDVGLKILEDIRNALETVSVRKPP<br>SITEEYVTKQLEKLSRKYKINAFNSNRFKQITEQVLRKYNNGELPKISEVFYRY<br>PRESHVAIRILPVKISNPRKDISYLLDKYQISPDWKNSNPGEVVDLIEIYKLTL<br>GWLLSCNKDESMDFSSYDLKLFPEAASLIKNFGSCLSGYYLSKMIENCITSEIK<br>GMITLYTRDKFVVRYVTQMIGSNQKFPLLCLVGEKQTKNFSRNWGVLIEEKGDL<br>GEEKNQEKCLIFKDKTDFAKAKEVEIFKNNIWRIRTSKYQIQFLNRLEKKTKEW<br>DLMNLVLSEPSLVLEEEWGVSWDKDKLLPLLKKEKSCEERLYYSLPLNLVPATD<br>YKEQSAEIEQRNTYLGLDVGEFGVAYAVVRIVRDRIELLSWGFLKDPALRKIRE<br>RVQDMKKKQVMAVESSSSTAVARVREMAIHSLRNQIHSIALAYKAKIIYEISIS<br>NFETGGNRMAKIYRSIKVSDVYRESGADTLVSEMIWGKKNKQMGNHISSYATSY<br>TCCNCARTPFELVIDNDKEYEKGGDEFIFNVGDEKKVRGFLQKSLLGKTIKGKE<br>VLKSIKEYARPPIREVLLEGEDVEQLLKRRGNSYIYRCPFCGYKTDADIQAALN<br>IACRGYISDNAKDAVKEGERKLDYILEVRKLWEKNGAVLRSAKEL |
| 7 | CasPhi | MADTPTLFTQFLRHHLPGQRFRKDILKQAGRILANKGEDATIAFLRGKSEESPP<br>DFQPPVKCPIIACSRPLTEWPIYQASVAIQGYVYGQSLAEFEASDPGCSKDGLL<br>GWFDKTGVCTDYFSVQGLNLIFQNARKRYIGVQTKVTNRNEKRHKKLKRINAKR<br>IAEGLPELTSDEPESALDETGHLIDPPGLNTNIYCYQQVSPKPLALSEVNQLPT |

TABLE 18-continued

Sequence listing.

| SEQ | Description | Sequence |
|---|---|---|
| | | AYAGYSTSGDDPIQPMVTKDRLSISKGQPGYIPEHQRALLSQKKHRRMRGYGLK<br>ARALLVIVRIQDDWAVIDLRSLLRNAYWRRIVQTKEPSTITKLLKLVTGDPVLD<br>ATRMVATFTYKPGIVQVRSAKCLKNKQGSKLESERYLNETVSVTSIDLGSNNLV<br>AVATYRLVNGNTPELLQRFTLPSHLVKDFERYKQAHDTLEDSIQKTAVASLPQG<br>QQTEIRMWSMYGFREAQERVCQELGLADGSIPWNVMTATSTILTDLFLARGGDP<br>KKCMFTSEPKKKKNSKQVLYKIRDRAWAKMYRTLLSKETREAWNKALWGLKRGS<br>PDYARLSKRKEELARRCVNYTISTAEKRAQCGRTIVALEDLNIGFFHGRGKQEP<br>GWVGLFTRKKENRWLMQALHKAFLELAHHRGYHVIEVNPAYTSQTCPVCRHCDP<br>DNRDQHNREAFHCIGCGFRGNADLDVATHNIAMVAITGESLKRARGSVASKTPQ<br>PLAAE |
| 8 | Cas12f1 (Cas14a) | MIKVYRYEIVKPLDLDWKEFGTILRQLQQETRFALNKATQLAWEWMGESSDYKD<br>NHGEYPKSKDILGYTNVHGYAYHTIKTKAYRLNSGNLSQTIKRATDRFKAYQKE<br>ILRGDMSIPSYKRDIPLDLIKENISVNRMNHGDYIASLSLLSNPAKQEMNVKRK<br>ISVIIIVRGAGKTIMDRILSGEYQVSASQIIHDDRKNKWYLNISYDFEPQTRVL<br>DLNKIMGIDLGVAVAVYMAFQHTPARYKLEGGEIENFRRQVESRRISMLRQGKY<br>AGGARGGHGRDKRIKPIEQLRDKIANFRDTTNHRYSRYIVDMAIKEGCGTIQME<br>DLTNIRDIGSRFLQNWTYYDLQQKIIYKAEEAGIKVIKIDPQYTSQRCSECGNI<br>DSGNRIGQAIFKCRACGYEANADYNAARNIAIPNIDKIIAESIKSGGS |
| 9 | Cas 12f2 (Cas14b) | NAMIAQKTIKIKLNPTKEQIIKLNSIIEEYIKVSNFTAKKIAEIQESFTDSGLT<br>QGTCSECGKEKTYRKYHLLKKDNKLFCITCYKRKYSQFTLQKVEFQNKTGLRNV<br>AKLPKTYYTNAIRFASDTFSGFDEIIKKKQNRLNSIQNRLNFWKELLYNPSNRN<br>EIKIKVVKYAPKTDTREHPHYYSEAEIKGRIKRLEKQLKKFKMPKYPEFTSETI<br>SLQRELYSWKNPDELKISSITDKNESMNYYGKEYLKRYIDLINSQTPQILLEKE<br>NNSFYLCFPITKNIEMPKIDDTFEPVGIDWGITRNIAVVSILDSKTKKPKFVKE<br>YSAGYILGKRKHYKSLRKHFGQKKRQDKINKLGTKEDRFIDSNIHKLAFLIVKE<br>IRNHSNKPIILMENITDNREEAEKSMRQNILLHSVKSRLQNYIAYKALWNNIPT<br>NLVKPEHTSQICNRCGHQDRENRPKGSKLFKCVKCNYMSNADENASINIARKFY<br>IGEYEPFYKDNEKMKSGVNSISM |
| 10 | Cas12f3 (Cas14c) | MEVQKTVMKTLSLRILRPLYSQEIEKEIKEEEKERRKQAGGTGELDGGFYKKLE<br>KKHSEMFSFDRLNLLLNQLQREIAKVYNHAISELYIATIAQGNKSNKHYISSIV<br>YNRAYGYFYNAYIALGICSKVEANFRSNELLTQQSALPTAKSDNFPIVLHKQKG<br>AEGEDGGFRISTEGSDLIFEIPIPFYEYNGENRKEPYKWVKKGGQKPVLKLILS<br>TFRRQRNKGWAKDEGTDAEIRKVTEGKYQVSQIEINRGKKLGEHQKWFANFSIE<br>QPIYERKPNRSIVGGLDVGIRSPLVCAINNSFSRYSVDSNDVEKFSKQVFAFRR<br>RLLSKNSLKRKHGHAAHKLEPITEMTEKNDKERKKIIERWAKEVTNFFVKNQVG<br>IVQIEDLSTMKDREDHFFNQYLRGFWPYYQMQTLIENKLKEYGIEVKRVQAKYT<br>SQLCSNPNCRYWNNYENFEYRKVNKFPKEKCEKCNLEISADYNAARNLSTPDIE<br>KFVAKATKGINLPEK |
| 11 | C2c8 | MKVLEFKIHPTEEQVSKIDQSLAACKLLWNLSIALKEESKQRYYRKKHKEDEFS<br>PEIWGLSYSGHYDEKEFKTLKDKEKKLLIGNPCCKIAYFKKTSNGKEYTPLNSI<br>PIRREMNAENIDKDAVNYLNRKKLAFYFRENTAKFIGEIETEFKKGFFKSVIKP<br>AYDAAKKGIRGIPRFKGRRDKVETLVNGQPETIKIKSNGVIVSSKIGLLKIRGL<br>DRLQGKAPRMAKITRKATGYYLQLTIETDDTIYKESDKCVGLDMGAVAIFTDDL<br>GRQSEAKRYAKIQKKRLNRLQRQASRQKDSNNQRKTYAKLARVHEKIARQRKG<br>RNAQLAHKITSEYQSVILEDLNLKNMTAAAKPKEREDGDGYKQNGKKRKSGLNK<br>ALLDNAIGQLRTFIENKANERGRKIIRVNPKHTSQTCPNCGNIDKANRVSQSKF<br>KCVSCGYEAHADQNAAANILIRGLRDEFLRAIGSLYKFPVSMIGKYPGLAGEFT<br>PDLDANQESIGDAPIENAEHSISKQMKQEGNRTPTQPENGSQSLIFLSAPPQPC<br>GDSHGTNNPKALPNKASKRSSKKPRGAIPENPDQLTIWDLLD |
| 12 | dSpCas9 | MDKKYSIGLAIGTNSVGWAVITDEYKVPSKKFKVLGNTDRHSIKKNLIGALLED<br>SGETAEATRLKRTARRRYTRRKNRICYLQEIFSNEMAKVDDSFFHRLEESELVE<br>EDKKHERHPIFGNIVDEVAYHEKYPTIYHLRKKLVDSTDKADLRLIYLALAHMI<br>KFRGHFLIEGDLNPDNSDVDKLFIQLVQTYNQLFEENPINASGVDAKAILSARL<br>SKSRRLENLIAQLPGEKKNGLFGNLIALSLGLTPNFKSNEDLAEDAKLQLSKDT<br>YDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIKP<br>ILEKMDGTEELLVKLNREDLLRKQRTEDNGSIPHQIHLGELHAILRRQEDFYPF<br>LKDNREKIEKILTFRIPYYVGPLARGNSRFAWMTRKSEETITPWNFEEVVDKGA<br>SAQSFIERMTNFDKNLPNEKVLPKHSLLYEYFTVYNELTKVKYVTEGMRKPAFL<br>SGEQKKAIVDLLFKTNRKVTVKQLKEDYFKKIECFDSVEISGVEDRENASLGTY<br>HDLLKIIKDKDFLDNEENEDILEDIVLTLTLFEDREMIEERLKTYAHLEDDKVM<br>KQLKRRRYTGWGRLSRKLINGIRDKQSGKTILDFLKSDGFANRNFMQLIHDDSL<br>TFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEK<br>LYLYYLQNGRDMYVDQELDINRLSDYDVDAIVPQSFLKDDSIDNKVLTRSDKNR<br>GKSDNVPSEEVVKKMKNYWRQLLNAKLITQRKFDNLTKAERGGLSELDKAGFIK<br>RQLVETRQITKHVAQILDSRMNTKYDENDKLIREVKVITLKSKLVSDFRKDFQF<br>YKVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDE<br>ATVRKVLSMPQVNIVKKTEVQTGGFSKESILPKRNSDKLIARKKDWDPKKYGGF<br>DSPTVAYSVLVVAKVEKGKSKKLKSVKELLGITIMERSSFEKNPIDFLEAKGYK |

TABLE 18-continued

Sequence listing.

| SEQ | Description | Sequence |
|---|---|---|
| | | EVKKDLIIKLPKYSLFELENGRKRMLASAGELQKGNELALPSKYVNFLYLASHY<br>EKLKGSPEDNEQKQLFVEQHKHYLDEIIEQISEFSKRVILADANLDKVLSAYNK<br>HRDKPIREQAENIIHLFTLTNLGAPAAFKYFDTTIDRKRYTSTKEVLDATLIHQ<br>SITGLYETRIDLSQLGGD |
| 13 | dSaCas9 | MKRNYILGLAIGITSVGYGIIDYETRDVIDAGVRLFKEANVENNEGRRSKRGAR<br>RLKRRRRHRIQRVKKLLFDYNLLTDHSELSGINPYEARVKGLSQKLSEEEFSAA<br>LLHLAKRRGVHNVNEVEEDTGNELSTKEQISRNSKALEEKYVAELQLERLKKDG<br>EVRGSINRFKTSDYVKEAKQLLKVQKAYHQLDQSFIDTYIDLLETRRTYYEGPG<br>EGSPFGWKDIKEWYEMLMGHCTYFPEELRSVKYAYNADLYNALNDLNNLVITRD<br>ENEKLEYYEKFQIIENVFKQKKKPTLKQIAKEILVNEEDIKGYRVTSTGKPEFT<br>NLKVYHDIKDITARKEIIENAELLDQIAKILTIYQSSEDIQEELTNLNSELTQE<br>EIEQISNLKGYTGTHNLSLKAINLILDELWHTNDNQIAIFNRLKLVPKKVDLSQ<br>QKEIPTTLVDDFILSPVVKRSFIQSIKVINAIIKKYGLPNDIIIELAREKNSKD<br>AQKMINEMQKRNRQTNERIEEIIRTTGKENAKYLIEKIKLHDMQEGKCLYSLEA<br>IPLEDLLNNPFNYEVDHIIPRSVSFDNSFNNKVLVKQEEASKKGNRTPFQYLSS<br>SDSKISYETFKKHILNLAKGKGRISKTKKEYLLEERDINRFSVQKDFINRNLVD<br>TRYATRGLMNLLRSYFRVNNLDVKVKSINGGFTSFLRRKWKFKKERNKGYKHHA<br>EDALIIANADFIFKEWKKLDKAKKVMENQMFEEKQAESMPEIETEQEYKEIFIT<br>PHQIKHIKDFKDYKYSHRVDKKPNRELINDTLYSTRKDDKGNTLIVNNLNGLYD<br>KDNDKLKKLINKSPEKLLMYHHDPQTYQKLKLIMEQYGDEKNPLYKYYEETGNY<br>LTKYSKKDNGPVIKKIKYYGNKLNAHLDITDDYPNSRNKVVKLSLKPYREDVYL<br>DNGVYKFVTVKNLDVIKKENYYEVNSKCYEEAKKLKKISNQAEFIASFYNNDLI<br>KINGELYRVIGVNNDLLNRIEVNMIDITYREYLENMNDKRPPRIIKTIASKTQS<br>IKKYSTDILGNLYEVKSKKHPQIIKKG |
| 14 | inactive FnCpf1 | MSIYQEFVNKYSLSKTLRFELIPQGKTLENIKARGLILDDEKRAKDYKKAKQII<br>DKYHQFFIEEILSSVCISEDLLQNYSDVYFKLKKSDDDNLQKDEKSAKDTIKKQ<br>ISEYIKDSEKFKNLENQNLIDAKKGQESDLILWLKQSKDNGIELFKANSDITDI<br>DEALEIIKSFKGWTTYFKGFHENRKNVYSSNDIPTSIIYRIVDDNLPKFLENKA<br>KYESLKDKAPEAINYEQIKKDLAEELTFDIDYKTSEVNQRVESLDEVFEIANEN<br>NYLNQSGITKENTIIGGKFVNGENTKRKGINEYINLYSQQINDKTLKKYKMSVL<br>FKQILSDTESKSFVIDKLEDDSDVVTTMQSFYEQIAAFKTVEEKSIKETLSLLE<br>DDLKAQKLDLSKIYFKNDKSLTDLSQQVEDDYSVIGTAVLEYITQQIAPKNLDN<br>PSKKEQELIAKKTEKAKYLSLETIKLALEEENKHRDIDKQCRFEEILANFAAIP<br>MIFDEIAQNKDNLAQISIKYQNQGKKDLLQASAEDDVKAIKDLLDQTNNLLHKL<br>KIFHISQSEDKANILDKDEHFYLVFEECYFELANIVPLYNKIRNYITQKPYSDE<br>KFKLNFENSTLANGWDKNKEPDNTAILFIKDDKYYLGVMNKKNNKIFDDKAIKE<br>NKGEGYKKIVYKLLPGANKMLPKVFFSAKSIKFYNPSEDILRIRNHSTHTKNGS<br>PQKGYEKFEFNIEDCRKFIDFYKQSISKHPEWKDFGFRESDTQRYNSIDEFYRE<br>VENQGYKLTFENISESYIDSVVNQGKLYLFQIYNKDFSAYSKGRPNLHTLYWKA<br>LFDERNLQDVVYKLNGEAELFYRKQSIPKKITHPAKEAIANKNKDNPKKESVFE<br>YDLIKDKRFTEDKFFFHCPITINFKSSGANKENDEINLLLKEKANDVHILSIAR<br>GERHLAYYTLVDGKGNIIKQDTENIIGNDRMKTNYHDKLAAIEKDRDSARKDWK<br>KINNIKEMKEGYLSQVVHEIAKLVIEYNAIVVFEDLNFGEKRGREKVEKQVYQK<br>LEKMLIEKLNYLVFKDNEFDKTGGVLRAYQLTAPPFETFKKMGKQTGIIYYVPAG<br>FTSKICPVTGFVNQLYPKYESVSKSQEFFSKFDKICYNLDKGYFEFSEDYKNFG<br>DKAAKGKWTIASFGSRLINFRNSDKNHNWDTREVYPTKELEKLLKDYSIEYGHG<br>ECIKAAICGESDKKFFAKLTSVLNTILQMRNSKTGTELDYLISPVADVNGNEED<br>SRQAPKNMPQDADANGAYHIGLKGLMLLGRIKNNQEGKKLNLVIKNEEYFEFVQ<br>NRNN |
| 15 | dNmeCas9 | MAAFKPNSINYILGLAIGIASVGWAMVEIDEEENPIRLIDLGVRVFERAEVPKT<br>GDSLAMARRLARSVRRLTRRRAHLLRTRRLLKREGVLQAANEDENGLIKSLPN<br>TPWQLRAAALDRKLTPLEWSAVLLHLIKHRGYLSQRKNEGETADKELGALLKGV<br>AGNAHALQTGDFRTPAELALNKFEKESGHIRNQRSDYSHTFSRKDLQAELILLE<br>EKQKEFGNPHVSGGLKEGIETLLMTQRPALSGDAVQKMLGHCTFEPAEPKAAKN<br>TYTAERFIWLTKLNNLRILEQGSERPLTDTERATLMDEPYRKSKLTYAQARKLL<br>GLEDTAFFKGLRYGKDNAEASTLMEMKAYHAISRALEKEGLKDKKSPLNLSPEL<br>QDEIGTAFSLFKTDEDITGRLKDRIQPEILEALLKHISFDKFVQISLKALRRIV<br>PLMEQGKRYDEACAEIYGDHYGKKNTEEKIYLPPIPADEIRNPVVLRALSQARK<br>VINGVVRRYGSPARIHIETAREVGKSFKDRKEIEKRQEENRKDREKAAAKFREV<br>FPNFVGEPKSKDILKLRLYEQQHGKCLYSGKEINLGRLNEKGYVEIDAALPESR<br>TWDDSENNKVLVLGSENQNKGNQTPYEYENGKDNSREWQEFKARVETSREPRSK<br>KQRILLQKFDEDGEKERNLNDTRYVNRFLCQFVADRMRLTGKGKKRVFASNGQI<br>TNLLRGFWGLRKVRAENDRHHALDAVVVACSTVAMQQKITRFVRYKEMNAFDGK<br>TIDKETGEVLHQKTHFPQPWEFFAQEVMIRVFGKPDGKPEFEEADTLEKLRTLL<br>AEKLSSRPEAVHEYVTPLFVSRAPNRKMSGQGHMETVKSAKRLDEGVSVLRVPL<br>TQLKLKDLEKMVNREREPKLYEALKARLEAHKDDPAKAFAEPFYKYDKAGNRTQ<br>QVKAVRVEQVQKTGVWVRNHNGIADNATMVRVDVFEKGDKYYLVPIYSWQVAKG<br>ILPDRAVVQGKDEEDWQLIDDSENFKFSLHPNDLVEVITKKARMEGYFASCHRG<br>TGNINIRIHDLDHKIGKNGILEGIGVKTALSFQKYQIDELGKEIRPCRLKKRPP<br>VR |

TABLE 18-continued

Sequence listing.

| SEQ | Description | Sequence |
| --- | --- | --- |
| 16 | dCjCas9 | MARILAFAIGISSIGWAFSENDELKDCGVRIFTKVENPKTGESLALPRRLARSA RKRLARRKARLNHLKHLIANEFKLNYEDYQSFDESLAKAYKGSLISPYELRFRA LNELLSKQDFARVILHIAKRRGYDDIKNSDDKEKGAILKAIKQNEEKLANYQSV GEYLYKEYFQKFKENSKEFTNVRNKKESYERCIAQSFLKDELKLIFKKQREFGF SFSKKFEEEVLSVAFYKRALKDESHLVGNCSFFTDEKRAPKNSPLAFMFVALTR IINLLNNLKNTEGILYTKDDLNALLNEVLKNGTLTYKQTKKLLGLSDDYEFKGE KGTYFIEFKKYKEFIKALGEHNLSQDDLNEIAKDITLIKDEIKLKKALAKYDLN QNQIDSLSKLEFKDHLNISFKALKLVTPLMLEGKKYDEACNELNLKVAINEDKK DELPAFNETYYKDEVTNPVVLRAIKEYRKVLNALLKKYGKVHKINIELAREVGK NHSQRAKIEKEQNENYKAKKDAELECEKLGLKINSKNILKLRLFKEQKEFCAYS GEKIKISDLQDEKMLEIDAIYPYSRSFDDSYMNKVLVFTKQNQEKLNQTPFEAF GNDSAKWQKIEVLAKNLPTKKQKRILDKNYKDKEQKNEKDRNLNDTRYIARLVL NYTKDYLDFLPLSDDENTKLNDTQKGSKVHVEAKSGMLTSALRHTWGFSAKDRN NHLHHAIDAVIIAYANNSIVKAFSDEKKEQESNSAELYAKKISELDYKNKRKFF EPFSGFRQKVLDKIDEIFVSKPERKKPSGALHEETFRKEEEFYQSYGGKEGVLK ALELGKIRKVNGKIVKNGDMFRVDIFKHKKTNKFYAVPIYTMDFALKVLPNKAV ARSKKGEIKDWILMDENYEFCFSLYKDSLILIQTKDMQEPEFVYYNAFTSSTVS LIVSKHDNKFETLSKNQKILFKNANEKEVIAKSIGIQNLKVFEKYIVSALGEVT KAEFRQREDEKK |
| 17 | dSt1Cas9 | MGSDLVLGLAIGIGSVGVGILNKVTGEIIHKNSRIFPAAQAENNLVRRTNRQGR RLARRKKHRRVRLNRLFEESGLITDFTKISINLNPYQLRVKGLTDELSNEELFI ALKNMVKHRGISYLDDASDDGNSSVGDYAQIVKENSKQLETKTPGQIQLERYQT YGQLRGDFTVEKDGKKHRLINVFPTSAYRSEALRILQTQQEFNPQITDEFINRY LEILTGKRKYYHGPGNEKSRTDYGRYRTSGETLDNIFGILIGKCTFYPDEFRAA KASYTAQEFNLLNDLNNLTVPTETKKLSKEQKNQIINYVKNEKAMGPAKLFKYI AKLLSCDVADIKGYRIDKSGKAEIHTFEAYRKMKTLETLDIEQMDRETLDKLAY VLTLNTEREGIQEALEHEFADGSFSQKQVDELVQERKANSSIFGKGWHNFSVKL MMELIPELYETSEEQMTILTRLGKQKTTSSSNKTKYIDEKLLTEEIYNPVVAKS VRQAIKIVNAAIKEYGDEDNIVIEMARETNEDDEKKAIQKIQKANKDEKDAAML KAANQYNGKAELPHSVFHGHKQLATKIRLWHQQGERCLYTGKTISIHDLINNSN QFEVDAILPLSITFDDSLANKVLVYATANQEKGQRTPYQALDSMDDAWSFRELK AFVRESKTLSNKKKEYLLTEEDISKFDVRKKFIERNLVDTRYASRVVLNALQEH FRAHKIDTKVSVVRGQFTSQLRRHWGIEKTRDTYHHHAVDALIIAASSQLNLWK KQKNTLVSYSEDQLLDIETGELISDDEYKESVFKAPYQHFVDTLKSKEFEDSIL FSYQVDSKENRKISDATIYATRQAKVGKDKADETYVLGKIKDIYTQDGYDAFMK IYKKDKSKFLMYRHDPQTFEKVIEPILENYPNKQINEKGKEVPCNPFLKYKEEH GYIRKYSKKGNGPEIKSLKYYDSKLGNHIDITPKDSNNKVVLQSVSPWRADVYF NKTTGKYEILGLKYADLQFEKGTGTYKISQEKYNDIKKKEGVDSDSEFKFTLYK NDLLLVKDTETKEQQLFRELSRTMPKQKHYVELKPYDKQKFEGGEALIKVLGNV ANSGQCKKGLGKSNISIYKVRTDVLGNQHIIKNEGDKPKLDE |
| 18 | dSt3Cas9 | MTKPYSIGLAIGTNSVGWAVITDNYKVPSKKMKVLGNTSKKYIKKNLLGVLLED SGITAEGRRLKRTARRRYTRRRNRILYLQEIFSTEMATLDDAFFQRLDDSELVP DDKRDSKYPIFGNLVEEKVYHDEFPTIYHLRKYLADSTKKADLRLVYLALAHMI KYRGHFLIEGEFNSKNNDIQKNFQDELDTYNAIFESDLSLENSKQLEEIVKDKI SKLEKKDRILKLFPGEKNSGIFSEFLKLIVGNQADERKCENLDEKASLHESKES YDEDLETLLGYIGDDYSDVELKAKKLYDAILLSGELTVTDNETEAPLSSAMIKR YNEHKEDLALLKEYIRNISLKTYNEVEKDDTKNGYAGYIDGKTNQEDFYVYLKN LLAEFEGADYFLEKIDREDFLRKQRTEDNGSIPYQIHLQEMRAILDKQAKFYPF LAKNKERIEKILTFRIPYYVGPLARGNSDFAWSIRKRNEKITPWNFEDVIDKES SAEAFINRMTSFDLYLPEEKVLPKHSLLYETENVYNELTKVRFIAESMRDYQFL DSKQKKDIVRLYFKDKRKVTDKDIIEYLHAIYGYDGIELKGIEKQFNSSLSTYH DLLNIINDKEFLDDSSNEAIIEEIIHTLTIFEDREMIKQRLSKFENIFDKSVLK KLSRRHYTGWGKLSAKLINGIRDEKSGNTILDYLIDDGISNRNEMQLIHDDALS FKKKIQKAQIIGDEDKGNIKEVVKSLPGSPAIKKGILQSIKIVDELVKMGGRK PESIVVEMARENQYTNQGKSNSQQRLKRLEKSLKELGSKILKENIPAKLSKIDN NALQNDRLYLYYLQNGKDMYTGDDLDIDRLSNYDIDHIIPQAFLKDNSIDNKVL VSSASARGKSDDFPSLEVVKKRKTFWYQLLKSKLISQRKEDNLTKAERGGLLPE DKAGFIQRQLVETRQITKHVARLLDEKENNKKDENNRAVRTVKIITLKSTLVSQ FRKDFELYKVREINDFHHAHDAYLNAVIASALLKKYPKLEPEFVYGDYPKYNSF RERKSATEKVYFYSNIMNIFKKSISLADGRVIERPLIEVNEETGESVWNKESDL ATVRRVLSYPQVNVVKKVEEQNHGLDRGKPKGLFNANLSSKPKPNSNENLVGAK EYLDPKKYGGYAGISNSFAVLVKGTIEKGAKKKITNVLEFQGISILDRINYRKD KLNFLLEKGYKDIELIIELPKYSLFELSDGSRRMLASILSTNNKRGEIHKGNQI FLSQKFVKLLYHAKRISNTINENHRKYVENHKKEFEELFYYILEFNENYVGAKK NGKLLNSAFQSWQNHSIDELCSSFIGPTGSERKGLFELTSRGSAADFEFLGVKI PRYRDYTPSSLLKDATLIHQSVTGLYETRIDLAKLGEG |
| 19 | dLbCpf1 | MSKLEKFTNCYSLSKTLRFKAIPVGKTQENIDNKRLLVEDEKRAEDYKGVKKLL DRYYLSFINDVLHSIKLKNLNNYISLFRKKTRTEKENKELENLEINLRKEIAKA FKGNEGYKSLFKKDIIETILPEFLDDKDEIALVNSENGFTTAFTGFFDNRENME SEEAKSTSIAFRCINENLTRYISNMDIFEKVDAIFDKHEVQEIKEKILNSDYDV EDFFEGEFFNFVLTQEGIDVYNAIIGGFVTESGEKIKGLNEYINLYNQKTKQKL PKFKPLYKQVLSDRESLSFYGEGYTSDEEVLEVERNTLNKNSEIFSSIKKLEKL |

TABLE 18-continued

Sequence listing.

| SEQ | Description | Sequence |
|---|---|---|
| | | FKNFDEYSSAGIFVKNGPAISTISKDIFGEWNVIRDKWNAEYDDIHLKKKAVVT
EKYEDDRRKSFKKIGSFSLEQLQEYADADLSVVEKLKEIIIQKVDEIYKVGSS
EKLFDADFVLEKSLKKNDAVVAIMKDLLDSVKSFENYIKAFFGEGKETNRDESE
YGDFVLAYDILLKVDHIYDAIRNYVTQKPYSKDKFKLYFQNPQFMGGWDKDKET
DYRATILRYGSKYYLAIMDKKYAKCLQKIDKDDVNGNYEKINYKLLPGPNKMLP
KVFFSKKWMAYYNPSEDIQKIYKNGTFKKGDMENLNDCHKLIDFFKDSISRYPK
WSNAYDENESETEKYKDIAGFYREVEEQGYKVSFESASKKEVDKLVEEGKLYMF
QIYNKDESDKSHGTPNLHTMYFKLLEDENNHGQIRLSGGAELFMRRASLKKEEL
VVHPANSPIANKNPDNPKKTTTLSYDVYKDKRESEDQYELHIPIAINKCPKNIF
KINTEVRVLLKHDDNPYVIGIARGERNLLYIVVVDGKGNIVEQYSLNEIINNEN
GIRIKTDYHSLLDKKEKERFEARQNWTSIENIKELKAGYISQVVHKICELVEKY
DAVIALEDLNSGFKNSRVKVEKQVYQKFEKMLIDKLNYMVDKKSNPCATGGALK
GYQITNKFESFKSMSTQNGFIFYIPAWLTSKIDPSTGFVNLLKTKYTSIADSKK
FISSFDRIMYVPEEDLFEFALDYKNFSRTDADYIKKWKLYSYGNRIRIFRNPKK
NNVFDWEEVCLTSAYKELENKYGINYQQGDIRALLCEQSDKAFYSSFMALMSLM
LQMRNSITGRTDVDFLISPVKNSDGIFYDSRNYEAQENAILPKNADANGAYNIA
RKVLWAIGQFKKAEDEKLDKVKIAISNKEWLEYAQTSVKH |
| 20 | inactive AsCpf1 | MTQFEGFTNLYQVSKTLRFELIPQGKTLKHIQEQGFIEEDKARNDHYKELKPII
DRIYKTYADQCLQLVQLDWENLSAAIDSYRKEKTEETRNALIEEQATYRNAIHD
YFIGRTDNLTDAINKRHAEIYKGLFKAELFNGKVLKQLGTVTTTEHENALLRSF
DKFTTYFSGFYENRKNVESAEDISTAIPHRIVQDNFPKEKENCHIFTRLITAVP
SLREHFENVKKAIGIFVSTSIEEVFSFPFYNQLLTQTQIDLYNQLLGGISREAG
TEKIKGLNEVLNLAIQKNDETAHIIASLPHRFIPLFKQILSDRNTLSFILEEFK
SDEEVIQSFCKYKTLLRRNENVLETAEALFNELNSIDLTHIFISHKKLETISSAL
CDHWDTLRNALYERRISELTGKITKSAKEKVQRSLKHEDINLQEIISAAGKELS
EAFKQKTSEILSHAHAALDQPLPTTLKKQEEKEILKSQLDSLLGLYHLLDWFAV
DESNEVDPEFSARLTGIKLEMEPSLSFYNKARNYATKKPYSVEKFKLNFQMPTL
ASGWDVNKEKNNGAILFVKNGLYYLGIMPKQKGRYKALSFEPTEKTSEGEDKMY
YDYFPDAAKMIPKCSTQLKAVTAHFQTHTTPILLSNNFIEPLEITKEIYDLNNP
EKEPKKFQTAYAKKTGDQKGYREALCKWIDFTRDFLSKYTKTTSIDLSSLRPSS
QYKDLGEYYAELNPLLYHISFQRIAEKEIMDAVETGKLYLFQIYNKDFAKGHHG
KPNLHTLYWTGLESPENLAKTSIKLNGQAELFYRPKSRMKRMAHRLGEKMLNKK
LKDQKTPIPDTLYQELYDYVNHRLSHDLSDEARALLPNVITKEVSHEIIKDRRF
TSDKFFFHVPITLNYQAANSPSKENQRVNAYLKEHPETPIIGIARGERNLIYIT
VIDSTGKILEQRSLNTIQQFDYQKKLDNREKERVAARQAWSVVGTIKDLKQGYL
SQVIHEIVDLMIHYQAVVVLENLNFGFKSKRTGIAEKAVYQQFEKMLIDKLNCL
VLKDYPAEKVGGVLNPYQLTDQFTSFAKMGTQSGELFYVPAPYTSKIDPLTGFV
DPFVWKTIKNHESRKHFLEGFDFLHYDVKTGDFILHFKMNRNLSFQRGLPGEMP
AWDIVFEKNETQFDAKGTPFIAGKRIVPVIENHRFTGRYRDLYPANELIALLEE
KGIVERDGSNILPKLLENDDSHAIDTMVALIRSVLQMRNSAATGEDYINSPVR
DLNGVCFDSRFQNPEWPMDADANGAYHIALKGQLLLNHLKESKDLKLQNGISNQ
DWLAYIQELRN |
| 21 | inactive enAsCpf1 | MTQFEGFTNLYQVSKTLRFELIPQGKTLKHIQEQGFIEEDKARNDHYKELKPII
DRIYKTYADQCLQLVQLDWENLSAAIDSYRKEKTEETRNALIEEQATYRNAIHD
YFIGRTDNLTDAINKRHAEIYKGLFKAELFNGKVLKQLGTVTTTEHENALLRSF
DKFTTYFSGFYRNRKNVESAEDISTAIPHRIVQDNFPKFKENCHIFTRLITAVP
SLREHFENVKKAIGIFVSTSIEEVFSFPFYNQLLTQTQIDLYNQLLGGISREAG
TEKIKGLNEVLNLAIQKNDETAHIIASLPHRFIPLFKQILSDRNTLSFILEEFK
SDEEVIQSFCKYKTLLRRNENVLETAEALFNELNSIDLTHIFISHKKLETISSAL
CDHWDTLRNALYERRISELTGKITKSAKEKVQRSLKHEDINLQEIISAAGKELS
EAFKQKTSEILSHAHAALDQPLPTTLKKQEEKEILKSQLDSLLGLYHLLDWFAV
DESNEVDPEFSARLTGIKLEMEPSLSFYNKARNYATKKPYSVEKFKLNFQMPTL
ARGWDVNREKNNGAILFVKNGLYYLGIMPKQKGRYKALSFEPTEKTSEGEDKMY
YDYFPDAAKMIPKCSTQLKAVTAHFQTHTTPILLSNNFIEPLEITKEIYDLNNP
EKEPKKFQTAYAKKTGDQKGYREALCKWIDFTRDELSKYTKTTSIDLSSLRPSS
QYKDLGEYYAELNPLLYHISFQRIAEKEIMDAVETGKLYLFQIYNKDFAKGHHG
KPNLHTLYWTGLESPENLAKTSIKLNGQAELFYRPKSRMKRMAHRLGEKMLNKK
LKDQKTPIPDTLYQELYDYVNHRLSHDLSDEARALLPNVITKEVSHEIIKDRRF
TSDKFFFHVPITLNYQAANSPSKENQRVNAYLKEHPETPIIGIARGERNLIYIT
VIDSTGKILEQRSLNTIQQFDYQKKLDNREKERVAARQAWSVVGTIKDLKQGYL
SQVIHEIVDLMIHYQAVVVLENLNFGFKSKRTGIAEKAVYQQFEKMLIDKLNCL
VLKDYPAEKVGGVLNPYQLTDQFTSFAKMGTQSGELFYVPAPYTSKIDPLTGFV
DPFVWKTIKNHESRKHFLEGFDFLHYDVKTGDFILHFKMNRNLSFQRGLPGEMP
AWDIVFEKNETQFDAKGTPFIAGKRIVPVIENHRFTGRYRDLYPANELIALLEE
KGIVERDGSNILPKLLENDDSHAIDTMVALIRSVLQMRNSAATGEDYINSPVR
DLNGVCFDSRFQNPEWPMDADANGAYHIALKGQLLLNHLKESKDLKLQNGISNQ
DWLAYIQELRN |
| 22 | inactive HFAsCpf1 | MTQFEGFTNLYQVSKTLRFELIPQGKTLKHIQEQGFIEEDKARNDHYKELKPII
DRIYKTYADQCLQLVQLDWENLSAAIDSYRKEKTEETRNALIEEQATYRNAIHD
YFIGRTDNLTDAINKRHAEIYKGLFKAELFNGKVLKQLGTVTTTEHENALLRSF
DKFTTYFSGFYRNRKNVESAEDISTAIPHRIVQDNFPKFKENCHIFTRLITAVP
SLREHFENVKKAIGIFVSTSIEEVFSFPFYNQLLTQTQIDLYNQLLGGISREAG
TEKIKGLNEVLALAIQKNDETAHIIASLPHRFIPLEKQILSDRNTLSFILEEFK |

TABLE 18-continued

Sequence listing.

| SEQ | Description | Sequence |
|---|---|---|
| | | SDEEVIQSFCKYKTLLRNENVLETAEALENELNSIDLTHIFISHKKLETISSAL<br>CDHWDTLRNALYERRISELTGKITKSAKEKVQRSLKHEDINLQEIISAAGKELS<br>EAFKQKTSEILSHAHAALDQPLPTTLKKQEEKEILKSQLDSLLGLYHLLDWFAV<br>DESNEVDPEFSARLTGIKLEMEPSLSFYNKARNYATKKPYSVEKFKLNFQMPTL<br>ARGWDVNREKNNGAILFVKNGLYYLGIMPKQKGRYKALSFEPTEKTSEGEDKMY<br>YDYFPDAAKMIPKCSTQLKAVTAHFQTHTTPILLSNNFIEPLEITKEIYDLNNP<br>EKEPKKFQTAYAKKTGDQKGYREALCKWIDETRDELSKYTKTTSIDLSSLRPSS<br>QYKDLGEYYAELNPLLYHISFQRIAEKEIMDAVETGKLYLFQIYNKDFAKGHHG<br>KPNLHTLYWTGLESPENLAKTSIKLNGQAELFYRPKSRMKRMAHRLGEKMLNKK<br>LKDQKTPIPDTLYQELYDYVNHRLSHDLSDEARALLPNVITKEVSHEIIKDRRF<br>TSDKFFFHVPITLNYQAANSPSKENQRVNAYLKEHPETPIIGIARGERNLIYIT<br>VIDSTGKILEQRSLNTIQQFDYQKKLDNREKERVAARQAWSVVGTIKDLKQGYL<br>SQVIHEIVDLMIHYQAVVVLENLNFGFKSKRTGIAEKAVYQQFEKMLIDKLNCL<br>VLKDYPAEKVGGVLNPYQLTDQFTSFAKMGTQSGELFYVPAPYTSKIDPLTGEV<br>DPFVWKTIKNHESRKHFLEGFDFLHYDVKTGDFILHFKMNRNLSFQRGLPGEMP<br>AWDIVFEKNETQFDAKGTPFIAGKRIVPVIENHRFTGRYRDLYPANELIALLEE<br>KGIVERDGSNILPKLLENDDSHAIDTMVALIRSVLQMRNSNAATGEDYINSPVR<br>DLNGVCFDSRFQNPEWPMDADANGAYHIALKGQLLLNHLKESKDLKLQNGISNQ<br>DWLAYIQELRN |
| 23 | inactive<br>RVRAsCpf1 | MTQFEGFTNLYQVSKTLRFELIPQGKTLKHIQEQGFIEEDKARNDHYKELKPII<br>DRIYKTYADQCLQLVQLDWENLSAAIDSYRKEKTEETRNALIEEQATYRNAIHD<br>YFIGRTDNLTDAINKRHAEIYKGLFKAELFNGKVLKQLGTVTTTEHENALLRSF<br>DKFTTYFSGFYENRKNVESAEDISTAIPHRIVQDNFPKFKENCHIFTRLITAVP<br>SLREHFENVKKAIGIFVSTSIEEVFSFPFYNQLLTQTQIDLYNQLLGGISREAG<br>TEKIKGLNEVLNLAIQKNDETAHIIASLPHRFIPLEKQILSDRNTLSFILEEFK<br>SDEEVIQSFCKYKTLLRNENVLETAEALENELNSIDLTHIFISHKKLETISSAL<br>CDHWDTLRNALYERRISELTGKITKSAKEKVQRSLKHEDINLQEIISAAGKELS<br>EAFKQKTSEILSHAHAALDQPLPTTLKKQEEKEILKSQLDSLLGLYHLLDWFAV<br>DESNEVDPEFSARLTGIKLEMEPSLSFYNKARNYATKKPYSVEKFKLNFQMPTL<br>ARGWDVNVEKNRGAILFVKNGLYYLGIMPKQKGRYKALSFEPTEKTSEGEDKMY<br>YDYFPDAAKMIPKCSTQLKAVTAHFQTHTTPILLSNNFIEPLEITKEIYDLNNP<br>EKEPKKFQTAYAKKTGDQKGYREALCKWIDFTRDELSKYTKTTSIDLSSLRPSS<br>QYKDLGEYYAELNPLLYHISFQRIAEKEIMDAVETGKLYLFQIYNKDFAKGHHG<br>KPNLHTLYWTGLFSPENLAKTSIKLNGQAELFYRPKSRMKRMAHRLGEKMLNKK<br>LKDQKTPIPDTLYQELYDYVNHRLSHDLSDEARALLPNVITKEVSHEIIKDRRF<br>TSDKFFFHVPITLNYQAANSPSKFNQRVNAYLKEHPETPIIGIARGERNLIYIT<br>VIDSTGKILEQRSLNTIQQFDYQKKLDNREKERVAARQAWSVVGTIKDLKQGYL<br>SQVIHEIVDLMIHYQAVVVLENLNFGFKSKRTGIAEKAVYQQFEKMLIDKLNCL<br>VLKDYPAEKVGGVLNPYQLTDQFTSFAKMGTQSGELFYVPAPYTSKIDPLTGFV<br>DPFVWKTIKNHESRKHFLEGFDFLHYDVKTGDFILHFKMNRNLSFQRGLPGFMP<br>AWDIVFEKNETQFDAKGTPFIAGKRIVPVIENHRFTGRYRDLYPANELIALLEE<br>KGIVERDGSNILPKLLENDDSHAIDTMVALIRSVLQMRNSNAATGEDYINSPVR<br>DLNGVCFDSRFQNPEWPMDADANGAYHIALKGQLLLNHLKESKDLKLQNGISNQ<br>DWLAYIQELRN |
| 24 | inactive<br>RRAsCpf1 | MTQFEGFTNLYQVSKTLRFELIPQGKTLKHIQEQGFIEEDKARNDHYKELKPII<br>DRIYKTYADQCLQLVQLDWENLSAAIDSYRKEKTEETRNALIEEQATYRNAIHD<br>YFIGRTDNLTDAINKRHAEIYKGLFKAELFNGKVLKQLGTVTTTEHENALLRSF<br>DKFTTYFSGFYENRKNVESAEDISTAIPHRIVQDNFPKFKENCHIFTRLITAVP<br>SLREHFENVKKAIGIFVSTSIEEVFSFPFYNQLLTQTQIDLYNQLLGGISREAG<br>TEKIKGLNEVLNLAIQKNDETAHIIASLPHRFIPLFKQILSDRNTLSFILEEFK<br>SDEEVIQSFCKYKTLLRNENVLETAEALFNELNSIDLTHIFISHKKLETISSAL<br>CDHWDTLRNALYERRISELTGKITKSAKEKVQRSLKHEDINLQEIISAAGKELS<br>EAFKQKTSEILSHAHAALDQPLPTTLKKQEEKEILKSQLDSLLGLYHLLDWFAV<br>DESNEVDPEFSARLTGIKLEMEPSLSFYNKARNYATKKPYSVEKFKLNFQMPTL<br>ARGWDVNKEKNNGAILFVKNGLYYLGIMPKQKGRYKALSFEPTEKTSEGEDKMY<br>YDYFPDAAKMIPRCSTQLKAVTAHFQTHTTPILLSNNFIEPLEITKEIYDLNNP<br>EKEPKKFQTAYAKKTGDQKGYREALCKWIDFTRDELSKYTKTTSIDLSSLRPSS<br>QYKDLGEYYAELNPLLYHISFQRIAEKEIMDAVETGKLYLFQIYNKDFAKGHHG<br>KPNLHTLYWTGLFSPENLAKTSIKLNGQAELFYRPKSRMKRMAHRLGEKMLNKK<br>LKDQKTPIPDTLYQELYDYVNHRLSHDLSDEARALLPNVITKEVSHEIIKDRRF<br>TSDKFFFHVPITLNYQAANSPSKENQRVNAYLKEHPETPIIGIARGERNLIYIT<br>VIDSTGKILEQRSLNTIQQFDYQKKLDNREKERVAARQAWSVVGTIKDLKQGYL<br>SQVIHEIVDLMIHYQAVVVLENLNFGFKSKRTGIAEKAVYQQFEKMLIDKLNCL<br>VLKDYPAEKVGGVLNPYQLTDQFTSFAKMGTQSGELFYVPAPYTSKIDPLTGFV<br>DPFVWKTIKNHESRKHFLEGEDFLHYDVKTGDFILHFKMNRNLSFQRGLPGEMP<br>AWDIVFEKNETQFDAKGTPFIAGKRIVPVIENHRFTGRYRDLYPANELIALLEE<br>KGIVERDGSNILPKLLENDDSHAIDTMVALIRSVLQMRNSNAATGEDYINSPVR<br>DLNGVCFDSRFQNPEWPMDADANGAYHIALKGQLLLNHLKESKDLKLQNGISNQ<br>DWLAYIQELRN |
| 25 | dCasX | MEKRINKIRKKLSADNATKPVSRSGPMKTLLVRVMTDDLKKRLEKRRKKPEVMP<br>QVISNNAANNLRMLLDDYTKMKEAILQVYWQEFKDDHVGLMCKFAQPASKKIDQ<br>NKLKPEMDEKGNLTTAGFACSQCGQPLFVYKLEQVSEKGKAYTNYFGRCNVAEH<br>EKLILLAQLKPEKDSDEAVTYSLGKFGQRALDFYSIHVTKESTHPVKPLAQIAG |

TABLE 18-continued

Sequence listing.

| SEQ | Description | Sequence |
|---|---|---|
| | | NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPVVERRENEVDWWNTINEVKKLIDAKRDMGRVFWSGVTAEKRNTILE<br>GYNYLPNENDHKKREGSLENPKKPAKRQFGDLLLYLEKKYAGDWGKVEDEAWER<br>IDKKIAGLTSHIEREEARNAEDAQSKAVLTDWLRAKASFVLERLKEMDEKEFYA<br>CEIQLQKWYGDLRGNPFAVEAENRVVDISGFSIGSDGHSIQYRNLLAWKYLENG<br>KREFYLLMNYGKKGRIRFTDGTDIKKSGKWQGLLYGGGKAKVIDLTEDPDDEQL<br>IILPLAFGTRQGREFIWNDLLSLETGLIKLANGRVIEKTIYNKKIGRDEPALFV<br>ALTFERREVVDPSNIKPVNLIGVARGENIPAVIALTDPEGCPLPEFKDSSGGPT<br>DILRIGEGYKEKQRAIQAAKEVEQRRAGGYSRKFASKSRNLADDMVRNSARDLF<br>YHAVTHDAVLVFANLSRGFGRQGKRTEMTERQYTKMEDWLTAKLAYEGLTSKTY<br>LSKTLAQYTSKTCSNCGFTITTADYDGMLVRLKKTSDGWATTLNNKELKAEGQI<br>TYYNRYKRQTVEKELSAELDRLSEESGNNDISKWTKGRRDEALFLLKKRFSHRP<br>VQEQFVCLDCGHEVHAAEQAALNIARSWLELNSNSTEFKSYKSGKQPFVGAWQA<br>FYKRRLKEVWKPNA |
| 26 | dCasPhi | MPKPAVESEFSKVLKKHFPGERFRSSYMKRGGKILAAQGEEAVVAYLQGKSEEE<br>PPNFQPPAKCHVVTKSRDFAEWPIMKASEAIQRYIYALSTTERAACKPGKSSES<br>HAAWFAATGVSNHGYSHVQGLNLIFDHTLGRYDGVLKKVQLRNEKARARLESIN<br>ASRADEGLPEIKAEEEEVATNETGHLLQPPGINPSFYVYQTISPQAYRPRDEIV<br>LPPEYAGYVRDPNAPIPLGVVRNRCDIQKGCPGYIPEWQREAGTAISPKTGKAV<br>TVPGLSPKKNKRMRRYWRSEKEKAQDALLVTRIGTDWVVIDVRGLLRNARWRT<br>IAPKDISLNALLDLFTGDPVIDVRRNIVTFTYTLDACGTYARKWTLKGKQTKAT<br>LDKLTATQTVALVAIALGQTNPISAGISRVTQENGALQCEPLDRFTLPDDLLKD<br>ISAYRIAWDRNEEELRARSVEALPEAQQAEVRALDGVSKETARTQLCADFGLDP<br>KRLPWDKMSSNTTFISEALLSNSVSRDQVFFTPAPKKGAKKKAPVEVMRKDRTW<br>ARAYKPRLSVEAQKLKNEALWALKRTSPEYLKLSRRKEELCRRSINYVIEKTRR<br>RTQCQIVIPVIEDLNVRFFHGSGKRLPGWDNFFTAKKENRWFIQGLHKAFSDLR<br>THRSFYVFEVRPERTSITCPKCGHCEVGNRDGEAFQCLSCGKTCNADLDVATHN<br>LTQVALTGKTMPKREEPRDAQGTAPARKTKKASKSKAPPAEREDQTPAQEPSQT<br>S |
| 27 | inactive VRER SpCas9 | MDKKYSIGLAIGTNSVGWAVITDEYKVPSKKFKVLGNTDRHSIKKNLIGALLED<br>SGETAEATRLKRTARRRYTRRKNRICYLQEIFSNEMAKVDDSFFHRLEESELVE<br>EDKKHERHPIFGNIVDEVAYHEKYPTIYHLRKKLVDSTDKADLRLIYLALAHMI<br>KFRGHFLIEGDLNPDNSDVDKLFIQLVQTYNQLFEENPINASGVDAKAILSARL<br>SKSRRLENLIAQLPGEKKNGLFGNLIALSLGLTPNEKSNEDLAEDAKLQLSKDT<br>YDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIKP<br>ILEKMDGTEELLVKLNREDLLRKQRTEDNGSIPHQIHLGELHAILRRQEDFYPF<br>LKDNREKIEKILTFRIPYYVGPLARGNSRFAWMTRKSEETITPWNFEEVVDKGA<br>SAQSFIERMTNFDKNLPNEKVLPKHSLLYEYFTVYNELTKVKYVTEGMRKPAFL<br>SGEQKKAIVDLLFKTNRKVTVKQLKEDYFKKIECFDSVEISGVEDRENASLGTY<br>HDLLKIIKDKDFELDNEENEDILEDIVLTLTLFEDREMIEERLKTYAHLEDDKVM<br>KQLKRRRYTGWGRLSRKLINGIRDKQSGKTILDFLKSDGFANRNEMQLIHDDSL<br>TFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEK<br>LYLYYLQNGRDMYVDQELDINRLSDYDVDAIVPQSFLKDDSIDNKVLTRSDKNR<br>GKSDNVPSEEVVKKMKNYWRQLLNAKLITQRKEDNLTKAERGGLSELDKAGFIK<br>RQLVETRQITKHVAQILDSRMNTKYDENDKLIREVKVITLKSKLVSDERKDFQF<br>YKVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDE<br>ATVRKVLSMPQVNIVKKTEVQTGGFSKESILPKRNSDKLIARKKDWDPKKYGGF<br>VSPTVAYSVLVVAKVEKGKSKKLKSVKELLGITIMERSSFEKNPIDFLEAKGYK<br>EVKKDLIIKLPKYSLFELENGRKRMLASARELQKGNELALPSKYVNFLYLASHY<br>EKLKGSPEDNEQKQLFVEQHKHYLDEIIEQISEFSKRVILADANLDKVLSAYNK<br>HRDKPIREQAENIIHLFTLTNLGAPAAFKYFDTTIDRKEYRSTKEVLDATLIHQ<br>SITGLYETRIDLSQLGGD |
| 28 | inactive EQR SpCas9 | MDKKYSIGLAIGTNSVGWAVITDEYKVPSKKFKVLGNTDRHSIKKNLIGALLED<br>SGETAEATRLKRTARRRYTRRKNRICYLQEIFSNEMAKVDDSFFHRLEESELVE<br>EDKKHERHPIFGNIVDEVAYHEKYPTIYHLRKKLVDSTDKADLRLIYLALAHMI<br>KFRGHFLIEGDLNPDNSDVDKLFIQLVQTYNQLFEENPINASGVDAKAILSARL<br>SKSRRLENLIAQLPGEKKNGLFGNLIALSLGLTPNEKSNEDLAEDAKLQLSKDT<br>YDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIKP<br>ILEKMDGTEELLVKLNREDLLRKQRTEDNGSIPHQIHLGELHAILRRQEDFYPE<br>LKDNREKIEKILTFRIPYYVGPLARGNSRFAWMTRKSEETITPWNFEEVVDKGA<br>SAQSFIERMTNFDKNLPNEKVLPKHSLLYEYFTVYNELTKVKYVTEGMRKPAFL<br>SGEQKKAIVDLLFKTNRKVTVKQLKEDYFKKIECFDSVEISGVEDRENASLGTY<br>HDLLKIIKDKDFELDNEENEDILEDIVLTLTLFEDREMIEERLKTYAHLEDDKVM<br>KQLKRRRYTGWGRLSRKLINGIRDKQSGKTILDELKSDGFANRNEMQLIHDDSL<br>TFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEK<br>LYLYYLQNGRDMYVDQELDINRLSDYDVDAIVPQSFLKDDSIDNKVLTRSDKNR<br>GKSDNVPSEEVVKKMKNYWRQLLNAKLITQRKFDNLTKAERGGLSELDKAGFIK |

TABLE 18-continued

Sequence listing.

| SEQ | Description | Sequence |
|---|---|---|
| | | RQLVETRQITKHVAQILDSRMNTKYDENDKLIREVKVITLKSKLVSDERKDFQF
YKVREINNYHHAHDAYLNAVVGTALIKKYPKLESEFVYGDYKVYDVRKMIAKSE
QEIGKATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKKYGGF
ESPTVAYSVLVVAKVEKGKSKKLKSVKELLGITIMERSSFEKNPIDELEAKGYK
EVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNK
HRDKPIREQAENIIHLETLTNLGAPAAFKYEDTTIDRKQYRSTKEVLDATLIHQ
SITGLYETRIDLSQLGGD |
| 29 | inactive VQR SpCas9 | MDKKYSIGLAIGTNSVGWAVITDEYKVPSKKFKVLGNTDRHSIKKNLIGALLED
SGETAEATRLKRTARRRYTRRKNRICYLQEIFSNEMAKVDDSFFHRLEESELVE
EDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARL
SKSRRLENLIAQLPGEKKNGLFGNLIALSLGLTPNFKSNEDLAEDAKLQLSKDT
YDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQEEFYKFIKP
ILEKMDGTEELLVKLNREDLLRKQRTEDNGSIPHQIHLGELHAILRRQEDFYPF
LKDNREKIEKILTFRIPYYVGPLARGNSRFAWMTRKSEETITPWNFEEVVDKGA
SAQSFIERMTNEDKNLPNEKVLPKHSLLYEYFTVYNELTKVKYVTEGMRKPAFL
SGEQKKAIVDLLFKTNRKVTVKQLKEDYFKKIECFDSVEISGVEDRENASLGTY
HDLLKIIKDKDFLDNEENEDILEDIVLTLTLFEDREMIEERLKTYAHLEDDKVM
KQLKRRRYTGWGRLSRKLINGIRDKQSGKTILDFLKSDGFANRNFMQLIHDDSL
TFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEK
LYLYYLQNGRDMYVDQELDINRLSDYDVDAIVPQSFLKDDSIDNKVLTRSDKNR
GKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDERKDFQF
YKVREINNYHHAHDAYLNAVVGTALIKKYPKLESEFVYGDYKVYDVRKMIAKSE
QEIGKATAKYFFYSNIMNFFKTEITLANGEIRKRPLIETNGETGEIVWDKGRDE
ATVRKVLSMPQVNIVKKTEVQTGGFSKESILPKRNSDKLIARKKDWDPKKYGGF
VSPTVAYSVLVVAKVEKGKSKKLKSVKELLGITIMERSSFEKNPIDFLEAKGYK
EVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNK
HRDKPIREQAENIIHLETLTNLGAPAAFKYEDTTIDRKQYRSTKEVLDATLIHQ
SITGLYETRIDLSQLGGD |
| 30 | inactive SPG SpCas9 | MDKKYSIGLAIGTNSVGWAVITDEYKVPSKKFKVLGNTDRHSIKKNLIGALLED
SGETAEATRLKRTARRRYTRRKNRICYLQEIFSNEMAKVDDSFFHRLEESELVE
EDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARL
SKSRRLENLIAQLPGEKKNGLFGNLIALSLGLTPNFKSNEDLAEDAKLQLSKDT
YDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQEEFYKFIKP
ILEKMDGTEELLVKLNREDLLRKQRTEDNGSIPHQIHLGELHAILRRQEDFYPE
LKDNREKIEKILTFRIPYYVGPLARGNSRFAWMTRKSEETITPWNFEEVVDKGA
SAQSFIERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRENASLGTY
HDLLKIIKDKDFLDNEENEDILEDIVLTLTLFEDREMIEERLKTYAHLEDDKVM
KQLKRRRYTGWGRLSRKLINGIRDKQSGKTILDFLKSDGFANRNFMQLIHDDSL
TFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEK
LYLYYLQNGRDMYVDQELDINRLSDYDVDAIVPQSFLKDDSIDNKVLTRSDKNR
GKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDERKDFQF
YKVREINNYHHAHDAYLNAVVGTALIKKYPKLESEFVYGDYKVYDVRKMIAKSE
QEIGKATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKKYGGE
LWPTVAYSVLVVAKVEKGKSKKLKSVKELLGITIMERSSFEKNPIDFLEAKGYK
EVKKDLIIKLPKYSLFELENGRKRMLASAKQLQKGNELALPSKYVNFLYLASHY
EKLKGSPEDNEQKQLFVEQHKHYLDEIIEQISEFSKRVILADANLDKVLSAYNK
HRDKPIREQAENIIHLFTLTNLGAPAAFKYFDTTIDRKQYRSTKEVLDATLIHQ
SITGLYETRIDLSQLGGD |
| 31 | inactive SpRY Cas9 | MDKKYSIGLAIGTNSVGWAVITDEYKVPSKKFKVLGNTDRHSIKKNLIGALLED
SGETAERTRLKRTARRRYTRRKNRICYLQEIFSNEMAKVDDSFFHRLEESELVE
EDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARL
SKSRRLENLIAQLPGEKKNGLFGNLIALSLGLTPNFKSNEDLAEDAKLQLSKDT
YDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQEEFYKFIKP
ILEKMDGTEELLVKLNREDLLRKQRTEDNGSIPHQIHLGELHAILRRQEDFYPF
LKDNREKIEKILTFRIPYYVGPLARGNSRFAWMTRKSEETITPWNFEEVVDKGA
SAQSFIERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRENASLGTY
HDLLKIIKDKDFLDNEENEDILEDIVLTLTLFEDREMIEERLKTYAHLEDDKVM |

TABLE 18-continued

Sequence listing.

| SEQ | Description | Sequence |
|---|---|---|
| | | KQLKRRRYTGWGRLSRKLINGIRDKQSGKTILDELKSDGFANRNEMQLIHDDSL<br>TFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEK<br>LYLYYLQNGRDMYVDQELDINRLSDYDVDAIVPQSFLKDDSIDNKVLTRSDKNR<br>GKSDNVPSEEVVKKMKNYWRQLLNAKLITQRKEDNLTKAERGGLSELDKAGFIK<br>RQLVETRQITKHVAQILDSRMNTKYDENDKLIREVKVITLKSKLVSDERKDFQF<br>YKVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESIRPKRNSDKLIARKKDWDPKKYGGF<br>LWPTVAYSVLVVAKVEKGKSKKLKSVKELLGITIMERSSFEKNPIDFLEAKGYK<br>EVKKDLIIKLPKYSLFELENGRKRMLASAKQLQKGNELALPSKYVNFLYLASHY<br>EKLKGSPEDNEQKQLFVEQHKHYLDEIIEQISEFSKRVILADANLDKVLSAYNK<br>HRDKPIREQAENIIHLFTLTRLGAPRAFKYFDTTIDPKQYRSTKEVLDATLIHQ<br>SITGLYETRIDLSQLGGD |
| 32 | inactive KKH dSaCas9 | MKRNYILGLAIGITSVGYGIIDYETRDVIDAGVRLFKEANVENNEGRRSKRGAR<br>RLKKRRRHRIQRVKKLLEDYNLLTDHSELSGINPYEARVKGLSQKLSEEEFSAA<br>LLHLAKRRGVHNVNEVEEDTGNELSTKEQISRNSKALEEKYVAELQLERLKKDG<br>EVRGSINRFKTSDYVKEAKQLLKVQKAYHQLDQSFIDTYIDLLETRRTYYEGPG<br>EGSPFGWKDIKEWYEMLMGHCTYFPEELRSVKYAYNADLYNALNDLNNLVITRD<br>ENEKLEYYEKFQIIENVFKQKKKPTLKQIAKEILVNEEDIKGYRVTSTGKPEFT<br>NLKVYHDIKDITARKEIIENAELLDQIAKILTIYQSSEDIQEELTNLNSELTQE<br>EIEQISNLKGYTGTHNLSLKAINLILDELWHTNDNQIAIFNRLKLVPKKVDLSQ<br>QKEIPTTLVDDFILSPVVKRSFIQSIKVINAIIKKYGLPNDIIIELAREKNSKD<br>AQKMINEMQKRNRQTNERIEEIIRTTGKENAKYLIEKIKLHDMQEGKCLYSLEA<br>IPLEDLLNNPFNYEVDHIIPRSVSEDNSENNKVLVKQEEASKKGNRTPFQYLSS<br>SDSKISYETFKKHILNLAKGKGRISKTKKEYLLEERDINRESVQKDFINRNLVD<br>TRYATRGLMNLLRSYFRVNNLDVKVKSINGGETSFLRRKWKFKKERNKGYKHHA<br>EDALIIANADFIFKEWKKLDKAKKVMENQMFEEKQAESMPEIETEQEYKEIFIT<br>PHQIKHIKDFKDYKYSHRVDKKPNRKLINDTLYSTRKDDKGNTLIVNNLNGLYD<br>KDNDKLKKLINKSPEKLLMYHHDPQTYQKLKLIMEQYGDEKNPLYKYYEETGNY<br>LTKYSKKDNGPVIKKIKYYGNKLNAHLDITDDYPNSRNKVVKLSLKPYREDVYL<br>DNGVYKFVTVKNLDVIKKENYYEVNSKCYEEAKKLKKISNQAEFIASFYKNDLI<br>KINGELYRVIGVNNDLLNRIEVNMIDITYREYLENMNDKRPPHIIKTIASKTQS<br>IKKYSTDILGNLYEVKSKKHPQIIKKG |
| 33 | mRNA0001 | SRPGERPFQCRICMRNFSKKENLLQHTRTHTGEKPFQCRICMRNFSRQDNLNSH<br>LRTHTGSQKPFQCRICMRNFSRSHNLKLHTRTHTGEKPFQCRICMRNFSQSTTL<br>KRHLRTHTGSQKPFQCRICMRNFSRNTNLTRHTRTHTGEKPFQCRICMRNESIK<br>HNLARHLRTHLRGS |
| 34 | mRNA0002 | SRPGERPFQCRICMRNFSKKENLLQHTRTHTGEKPFQCRICMRNFSRKDYLISH<br>LRTHTGSQKPFQCRICMRNFSRSHNLKLHTRTHTGEKPFQCRICMRNFSQSTTL<br>KRHLRTHTGSQKPFQCRICMRNFSRQDNLGRHLRTHTGEKPFQCRICMRNFSVV<br>NNLNRHLKTHLRGS |
| 35 | mRNA0003 | SRPGERPFQCRICMRNFSKKENLLQHTRTHTGEKPFQCRICMRNFSRKDYLISH<br>LRTHTGSQKPFQCRICMRNFSRSHNLRLHTRTHTGEKPFQCRICMRNFSQSTTL<br>KRHLRTHTGSQKPFQCRICMRNFSRQDNLGRHLRTHTGEKPFQCRICMRNFSVV<br>NNLNRHLKTHLRGS |
| 36 | mRNA0004 | SRPGERPFQCRICMRNFSRRHILDRHTRTHTGEKPFQCRICMRNFSRQDNLGRH<br>LRTHTGSQKPFQCRICMRNFSQSTTLKRHLRTHTGEKPFQCRICMRNFSRRDGL<br>AGHLKTHTGSQKPFQCRICMRNFSVHHNLVRHLRTHTGEKPFQCRICMRNESIS<br>HNLARHLKTHLRGS |
| 37 | mRNA0005 | SRPGERPFQCRICMRNFSRREVLENHLRTHTGEKPFQCRICMRNESRRDNLNRH<br>LKTHTGSQKPFQCRICMRNFSQSTTLKRHLRTHTGEKPFQCRICMRNESRRDGL<br>AGHLKTHTGSQKPFQCRICMRNFSVHHNLVRHLRTHTGEKPFQCRICMRNESIS<br>HNLARHLKTHLRGS |
| 38 | mRNA0006 | SRPGERPFQCRICMRNFSRRAVLDRHTRTHTGEKPFQCRICMRNFSRQDNLGRH<br>LRTHTGSQKPFQCRICMRNFSQSTTLKRHLRTHTGEKPFQCRICMRNFSRRDGL<br>AGHLKTHTGSQKPFQCRICMRNFSVHHNLVRHLRTHTGEKPFQCRICMRNESIS<br>HNLARHLKTHLRGS |
| 39 | mRNA0064 | SRPGERPFQCRICMRNFSRQEHLVRHLRTHTGEKPFQCRICMRNFSEGGNLMRH<br>LKTHTGSQKPFQCRICMRNFSSDRRDLDHTRTHTGEKPFQCRICMRNESSFQSY<br>LEHLRTHTGSQKPFQCRICMRNFSRPNHLAIHTRTHTGEKPFQCRICMRNESQS<br>PHLKRHLRTHLRGS |
| 40 | mRNA0007 | SRPGERPFQCRICMRNFSRREHLVRHLRTHTGEKPFQCRICMRNESDPSNLQRH<br>LKTHTGSQKPFQCRICMRNFSSDRRDLDHTRTHTGEKPFQCRICMRNESSFQSY<br>LEHLRTHTGSQKPFQCRICMRNFSRPNHLAIHTRTHTGEKPFQCRICMRNESQS<br>PHLKRHLRTHLRGS |

TABLE 18-continued

Sequence listing.

| SEQ | Description | Sequence |
|---|---|---|
| 41 | mRNA0008 | SRPGERPFQCRICMRNFSRREHLVRHLRTHTGEKPFQCRICMRNESDMGNLGRH LKTHTGSQKPFQCRICMRNFSSDRRDLDHTRTHTGEKPFQCRICMRNESSFQSY LEHLRTHTGSQKPFQCRICMRNFSRPNHLAIHTRTHTGEKPFQCRICMRNESQS PHLKRHLRTHLRGS |
| 42 | mRNA0009 | SRPGERPFQCRICMRNFSKKDHLHRHTRTHTGEKPFQCRICMRNFSQKEILTRH LRTHTGSQKPFQCRICMRNFSQSAHLKRHLRTHTGEKPFQCRICMRNFSETGSL RRHLKTHTGGGSQKPFQCRICMRNFSQSHSLKSHLRTHTGEKPFQCRICMRNF SESGHLKRHLKTHLRGS |
| 43 | mRNA0010 | SRPGERPFQCRICMRNFSKKDHLHRHTRTHTGEKPFQCRICMRNFSQKEILTRH LRTHTGSQKPFQCRICMRNFSQSAHLKRHLRTHTGEKPFQCRICMRNFSDRTPL NRHLKTHTGGGSQKPFQCRICMRNESQSHSLKSHLRTHTGEKPFQCRICMRNE SESGHLKRHLKTHLRGS |
| 44 | mRNA0011 | SRPGERPFQCRICMRNFSKTDHLARHTRTHTGEKPFQCRICMRNFSQKEILTRH LRTHTGSQKPFQCRICMRNFSQSAHLKRHLRTHTGEKPFQCRICMRNESETGSL RRHLKTHTGGGSQKPFQCRICMRNFSQKHHLVTHLRTHTGEKPFQCRICMRNE SENSKLRRHLKTHLRGS |
| 45 | mRNA0012 | SRPGERPFQCRICMRNFSQAGNLVRHLRTHTGEKPFQCRICMRNFSQNSHLRRH LKTHTGGGSQKPFQCRICMRNFSDLSTLRRHTRTHTGEKPFQCRICMRNFSQN EHLKVHLRTHTGSQKPFQCRICMRNFSGGTALRMHTRTHTGEKPFQCRICMRNF SQRSSLVRHLRTHLRGS |
| 46 | mRNA0013 | SRPGERPFQCRICMRNFSQRGNLQRHLRTHTGEKPFQCRICMRNFSQTTHLSRH LKTHTGGGSQKPFQCRICMRNFSDGSTLRRHTRTHTGEKPFQCRICMRNFSQK THLAVHLRTHTGSQKPFQCRICMRNFSGGTALRMHTRTHTGEKPFQCRICMRNE SQRSSLVRHLRTHLRGS |
| 47 | mRNA0014 | SRPGERPFQCRICMRNFSQRGNLQRHLRTHTGEKPFQCRICMRNFSQTTHLSRH LKTHTGGGSQKPFQCRICMRNFSDLSTLRRHTRTHTGEKPFQCRICMRNESQN EHLKVHLRTHTGSQKPFQCRICMRNFSGGSALSMHTRTHTGEKPFQCRICMRNE SQRSSLVRHLRTHLRGS |
| 48 | mRNA0015 | SRPGERPFQCRICMRNFSDRGNLTRHLRTHTGEKPFQCRICMRNFSQARSLRAH LKTHTGGGSQKPFQCRICMRNESEKASLIKHTRTHTGEKPFQCRICMRNFSDH SSLKRHLRTHTGSQKPFQCRICMRNFSRRFILSRHTRTHTGEKPFQCRICMRNE SRNDSLKCHLRTHLRGS |
| 49 | mRNA0016 | SRPGERPFQCRICMRNFSDRGNLTRHLRTHTGEKPFQCRICMRNFSQARSLRAH LKTHTGGGSQKPFQCRICMRNFSDKSSLRKHTRTHTGEKPFQCRICMRNESDH SSLKRHLRTHTGSQKPFQCRICMRNESRNFILQRHTRTHTGEKPFQCRICMRNF SRNDTLIIHLRTHLRGS |
| 50 | mRNA0017 | SRPGERPFQCRICMRNFSDRGNLTRHLRTHTGEKPFQCRICMRNFSQARSLRAH LKTHTGGGSQKPFQCRICMRNFSCNGSLKKHTRTHTGEKPFQCRICMRNESDH SSLKRHLRTHTGSQKPFQCRICMRNESRNFILQRHTRTHTGEKPFQCRICMRNE SRNDTLIIHLRTHLRGS |
| 51 | mRNA0018 | SRPGERPFQCRICMRNESRTDTLARHLRTHTGEKPFQCRICMRNFSRTDSLPRH LKTHTGGGSQKPFQCRICMRNFSDHSSLKRHLRTHTGEKPFQCRICMRNFSQP HGLAHHLKTHTGSQKPFQCRICMRNFSQSAHLKRHLRTHTGEKPFQCRICMRNE SVGNSLSRHLKTHLRGS |
| 52 | mRNA0019 | SRPGERPFQCRICMRNESRTDTLARHLRTHTGEKPFQCRICMRNFSRTDSLPRH LKTHTGGGSQKPFQCRICMRNFSDHSSLKRHLRTHTGEKPFQCRICMRNFSQP HGLRHHLKTHTGSQKPFQCRICMRNFSQSAHLKRHLRTHTGEKPFQCRICMRNE SVGNSLSRHLKTHLRGS |
| 53 | mRNA0020 | SRPGERPFQCRICMRNESRTDTLARHLRTHTGEKPFQCRICMRNFSRLDMLARH LKTHTGGGSQKPFQCRICMRNFSDHSSLKRHLRTHTGEKPFQCRICMRNFSQP HGLSTHLKTHTGSQKPFQCRICMRNFSQQAHLVRHTRTHTGEKPFQCRICMRNE SVHESLKRHLRTHLRGS |
| 54 | mRNA0021 | SRPGERPFQCRICMRNFSRADNLGRHLRTHTGEKPFQCRICMRNFSRNTHLSYH LKTHTGSQKPFQCRICMRNFSRGDGLRRHLRTHTGEKPFQCRICMRNFSRRDNL NRHLKTHTGSQKPFQCRICMRNESRARNLTLHTRTHTGEKPFQCRICMRNFSDP SSLKRHLRTHLRGS |
| 55 | mRNA0022 | SRPGERPFQCRICMRNFSRADNLGRHLRTHTGEKPFQCRICMRNESRNTHLSYH LKTHTGSQKPFQCRICMRNFSRKLGLLRHTRTHTGEKPFQCRICMRNFSRQDNL GRHLRTHTGSQKPFQCRICMRNFSRARNLTLHTRTHTGEKPFQCRICMRNFSDP SSLKRHLRTHLRGS |

TABLE 18-continued

Sequence listing.

| SEQ | Description | Sequence |
|---|---|---|
| 56 | mRNA0023 | SRPGERPFQCRICMRNFSRADNLGRHLRTHTGEKPFQCRICMRNESRNTHLSYH LKTHTGSQKPFQCRICMRNFSRKLGLLRHTRTHTGEKPFQCRICMRNFSRQDNL GRHLRTHTGSQKPFQCRICMRNFSRRRNLQLHTRTHTGEKPFQCRICMRNESDH SSLKRHLRTHLRGS |
| 57 | mRNA0024 | SRPGERPFQCRICMRNFSQQSSLLRHTRTHTGEKPFQCRICMRNFSRREHLVRH LRTHTGSQKPFQCRICMRNFSGLTALRTHTRTHTGEKPFQCRICMRNESERAKL IRHLRTHTGGGSQKPFQCRICMRNESAKRDLDRHTRTHTGEKPFQCRICMRNE SVNSSLTRHLRTHLRGS |
| 58 | mRNA0025 | SRPGERPFQCRICMRNFSQQSSLLRHTRTHTGEKPFQCRICMRNESRREHLVRH LRTHTGSQKPFQCRICMRNFSGLTALRTHTRTHTGEKPFQCRICMRNESERAKL IRHLRTHTGGGSQKPFQCRICMRNESLRKDLVRHTRTHTGEKPFQCRICMRNF SVRHSLTRHLRTHLRGS |
| 59 | mRNA0026 | SRPGERPFQCRICMRNFSQASALSRHTRTHTGEKPFQCRICMRNFSRREHLVRH LRTHTGSQKPFQCRICMRNFSGLTALRTHTRTHTGEKPFQCRICMRNESERAKL IRHLRTHTGGGSQKPFQCRICMRNESAKRDLDRHTRTHTGEKPFQCRICMRNE SVNSSLTRHLRTHLRGS |
| 60 | mRNA0061 | SRPGERPFQCRICMRNFSRGRNLEMHTRTHTGEKPFQCRICMRNFSDSSVLRRH LRTHTGGGSQKPFQCRICMRNESQNANLKRHTRTHTGEKPFQCRICMRNESQK HHLAVHLRTHTGSQKPFQCRICMRNESQRSNLARHLRTHTGEKPFQCRICMRNE SQKVHLEAHLKTHLRGS |
| 61 | mRNA0027 | SRPGERPFQCRICMRNFSRRRNLDVHTRTHTGEKPFQCRICMRNFSDSSVLRRH LRTHTGGGSQKPFQCRICMRNFSQNANLKRHTRTHTGEKPFQCRICMRNESQK HHLAVHLRTHTGSQKPFQCRICMRNESQRSNLARHLRTHTGEKPFQCRICMRNE SQKVHLEAHLKTHLRGS |
| 62 | mRNA0065 | SRPGERPFQCRICMRNFSRGRNLAIHTRTHTGEKPFQCRICMRNFSDSSVLRRH LRTHTGGGSQKPFQCRICMRNESLKSNLRHTRTHTGEKPFQCRICMRNESLK QHLVVHLRTHTGSQKPFQCRICMRNFSLKTNLARHTRTHTGEKPFQCRICMRNE SQKCHLKAHLRTHLRGS |
| 63 | mRNA0028 | SRPGERPFQCRICMRNFSDGSNLRRHLRTHTGEKPFQCRICMRNFSRIDNLDGH LKTHTGSQKPFQCRICMRNESQRRYLVEHTRTHTGEKPFQCRICMRNFSQQTNL ARHLRTHTGGGSQKPFQCRICMRNFSQRSDLTRHLRTHTGEKPFQCRICMRNE SRGDNLNRHLKTHLRGS |
| 64 | mRNA0029 | SRPGERPFQCRICMRNFSDPSNLQRHLRTHTGEKPFQCRICMRNESRRDNLPKH LKTHTGSQKPFQCRICMRNFSTTFNLRVHTRTHTGEKPFQCRICMRNESQTQNL TRHLRTHTGGGSQKPFQCRICMRNFSHKETLNRHLRTHTGEKPFQCRICMRNE SREDNLGRHLKTHLRGS |
| 65 | mRNA0030 | SRPGERPFQCRICMRNFSDPSNLQRHLRTHTGEKPFQCRICMRNFSRRDNLPKH LKTHTGSQKPFQCRICMRNFSQRRYLVEHTRTHTGEKPFQCRICMRNESQQTNL ARHLRTHTGGGSQKPFQCRICMRNFSQRSDLTRHLRTHTGEKPFQCRICMRNE SRGDNLNRHLKTHLRGS |
| 66 | mRNA0031 | SRPGERPFQCRICMRNFSQQTNLTRHLRTHTGEKPFQCRICMRNESANRTLVHH LKTHTGSQKPFQCRICMRNFSEEANLRRHTRTHTGEKPFQCRICMRNESRGEHL TRHLRTHTGSQKPFQCRICMRNFSTNSSLTRHLRTHTGEKPFQCRICMRNFSRI DNLIRHLKTHLRGS |
| 67 | mRNA0032 | SRPGERPFQCRICMRNFSQQTNLTRHLRTHTGEKPFQCRICMRNESANRTLVHH LKTHTGSQKPFQCRICMRNESEEANLRRHTRTHTGEKPFQCRICMRNESRREHL VRHLRTHTGSQKPFQCRICMRNESMTSSLRRHTRTHTGEKPFQCRICMRNESRQ DNLGRHLRTHLRGS |
| 68 | mRNA0033 | SRPGERPFQCRICMRNFSQQTNLTRHLRTHTGEKPFQCRICMRNESANRTLVHH LKTHTGSQKPFQCRICMRNFSEEANLRRHTRTHTGEKPFQCRICMRNFSRGEHL TRHLRTHTGSQKPFQCRICMRNFSMTSSLRRHTRTHTGEKPFQCRICMRNESRQ DNLGRHLRTHLRGS |
| 69 | mRNA0034 | SRPGERPFQCRICMRNFSRATHLTRHTRTHTGEKPFQCRICMRNFSRADVLKGH LRTHTGSQKPFQCRICMRNFSQRSSLVRHLRTHTGEKPFQCRICMRNESRKDAL HVHLKTHTGSQKPFQCRICMRNFSVHHNLVRHLRTHTGEKPFQCRICMRNESIS HNLARHLKTHLRGS |
| 70 | mRNA0035 | SRPGERPFQCRICMRNESRATHLTRHTRTHTGEKPFQCRICMRNFSRADVLKGH LRTHTGSQKPFQCRICMRNFSQSSSLVRHLRTHTGEKPFQCRICMRNFSRKERL ATHLKTHTGSQKPFQCRICMRNFSVRHNLTRHLRTHTGEKPFQCRICMRNESIS HNLARHLKTHLRGS |

TABLE 18-continued

Sequence listing.

| SEQ | Description | Sequence |
|---|---|---|
| 71 | mRNA0036 | SRPGERPFQCRICMRNFSKKDHLRHTRTHTGEKPFQCRICMRNFSRKESLTVH LRTHTGSQKPFQCRICMRNFSQSSSLVRHLRTHTGEKPFQCRICMRNFSRKERL ATHLKTHTGSQKPFQCRICMRNFSVHHNLVRHLRTHTGEKPFQCRICMRNESIS HNLARHLKTHLRGS |
| 72 | mRNA0037 | SRPGERPFQCRICMRNFSRVDHLHRHLRTHTGEKPFQCRICMRNFSRREHLSGH LKTHTGGGGSQKPFQCRICMRNFSQSSSLVRHLRTHTGEKPFQCRICMRNFSRK ERLATHLKTHTGSQKPFQCRICMRNFSVAHNLTRHLRTHTGEKPFQCRICMRNF SISHNLARHLKTHLRGS |
| 73 | mRNA0038 | SRPGERPFQCRICMRNFSRKHHLGRHTRTHTGEKPFQCRICMRNFSRREHLTIH LRTHTGGGGSQKPFQCRICMRNFSQSSSLVRHLRTHTGEKPFQCRICMRNESRK ERLATHLKTHTGSQKPFQCRICMRNESVAHNLTRHLRTHTGEKPFQCRICMRNE SISHNLARHLKTHLRGS |
| 74 | mRNA0039 | SRPGERPFQCRICMRNFSRVDHLHRHLRTHTGEKPFQCRICMRNFSRSDHLSLH LKTHTGGGGSQKPFQCRICMRNFSQSSSLVRHLRTHTGEKPFQCRICMRNFSRK ERLATHLKTHTGSQKPFQCRICMRNFSVAHNLTRHLRTHTGEKPFQCRICMRNE SISHNLARHLKTHLRGS |
| 75 | mRNA0040 | SRPGERPFQCRICMRNFSKTDHLARHTRTHTGEKPFQCRICMRNESQKEILTRH LRTHTGSQKPFQCRICMRNFSQSAHLKRHLRTHTGEKPFQCRICMRNESETGSL RRHLKTHTGSQKPFQCRICMRNFSQSSSLVRHLRTHTGEKPFQCRICMRNESQT NTLGRHLKTHLRGS |
| 76 | mRNA0041 | SRPGERPFQCRICMRNFSKKDHLRHTRTHTGEKPFQCRICMRNFSQKEILTRH LRTHTGSQKPFQCRICMRNFSQSAHLKRHLRTHTGEKPFQCRICMRNESETGSL RRHLKTHTGSQKPFQCRICMRNFSQSSSLVRHLRTHTGEKPFQCRICMRNFSQG GTLRRHLKTHLRGS |
| 77 | mRNA0042 | SRPGERPFQCRICMRNFSKKDHLRHTRTHTGEKPFQCRICMRNFSQKEILTRH LRTHTGSQKPFQCRICMRNFSQSAHLKRHLRTHTGEKPFQCRICMRNFSDPTSL NRHLKTHTGSQKPFQCRICMRNFSQSSSLVRHLRTHTGEKPFQCRICMRNESQT NTLGRHLKTHLRGS |
| 78 | mRNA0043 | SRPGERPFQCRICMRNFSQQTNLTRHLRTHTGEKPFQCRICMRNFSVGGNLARH LKTHTGSQKPFQCRICMRNESKRYNLYQHTRTHTGEKPFQCRICMRNESRQDNL NTHLRTHTGSQKPFQCRICMRNFSRSHNLKLHTRTHTGEKPFQCRICMRNESQS TTLKRHLRTHLRGS |
| 79 | mRNA0044 | SRPGERPFQCRICMRNFSQQTNLTRHLRTHTGEKPFQCRICMRNFSVGGNLSRH LKTHTGSQKPFQCRICMRNFSKRYNLYQHTRTHTGEKPFQCRICMRNESRQDNL NTHLRTHTGSQKPFQCRICMRNFSRSHNLRLHTRTHTGEKPFQCRICMRNESQS TTLKRHLRTHLRGS |
| 80 | mRNA0045 | SRPGERPFQCRICMRNFSQQTNLTRHLRTHTGEKPFQCRICMRNFSVGGNLSRH LKTHTGSQKPFQCRICMRNESKKENLLQHTRTHTGEKPFQCRICMRNESRRDNL KSHLRTHTGSQKPFQCRICMRNFSRSHNLKLHTRTHTGEKPFQCRICMRNFSQS TTLKRHLRTHLRGS |
| 81 | mRNA0046 | SRPGERPFQCRICMRNFSDKSSLRKHTRTHTGEKPFQCRICMRNFSDHSSLKRH LRTHTGSQKPFQCRICMRNESRNFILQRHTRTHTGEKPFQCRICMRNESRNDTL IIHLRTHTGGGGSQKPFQCRICMRNFSTSTLLKRHTRTHTGEKPFQCRICMRNE SLKEHLTRHLRTHLRGS |
| 82 | mRNA0047 | SRPGERPFQCRICMRNFSCNGSLKKHTRTHTGEKPFQCRICMRNFSDHSSLKRH LRTHTGSQKPFQCRICMRNFSRNFILARHTRTHTGEKPFQCRICMRNFSRQDIL VVHLRTHTGGGGSQKPFQCRICMRNFSHKSSLTRHLRTHTGEKPFQCRICMRNE SESGHLKRHLKTHLRGS |
| 83 | mRNA0048 | SRPGERPFQCRICMRNFSCNGSLKKHTRTHTGEKPFQCRICMRNFSDHSSLKRH LRTHTGSQKPFQCRICMRNFSRNFILARHTRTHTGEKPFQCRICMRNFSRQDIL VVHLRTHTGGGGSQKPFQCRICMRNFSTSTLLKRHTRTHTGEKPFQCRICMRNE SLKEHLTRHLRGS |
| 84 | mRNA0049 | SRPGERPFQCRICMRNESTNNNLARHTRTHTGEKPFQCRICMRNFSRTDSLTLH LRTHTGSQKPFQCRICMRNFSQREHLTTHLRTHTGEKPFQCRICMRNESRRDNL NRHLKTHTGSQKPFQCRICMRNFSRRQKLTIHTRTHTGEKPFQCRICMRNESHK SSLTRHLRTHLRGS |
| 85 | mRNA0050 | SRPGERPFQCRICMRNESTNNNLARHTRTHTGEKPFQCRICMRNESRTDSLTLH LRTHTGSQKPFQCRICMRNFSQREHLTTHLRTHTGEKPFQCRICMRNFSRGDNL KRHLKTHTGSQKPFQCRICMRNFSRRQKLTIHTRTHTGEKPFQCRICMRNESHK SSLTRHLRTHLRGS |

TABLE 18-continued

Sequence listing.

| SEQ | Description | Sequence |
|---|---|---|
| 86 | mRNA0066 | SRPGERPFQCRICMRNESTNNNLARHTRTHTGEKPFQCRICMRNFSRTDSLTLH LRTHTGSQKPFQCRICMRNESQREHLNGHLRTHTGEKPFQCRICMRNESRGDNL ARHLKTHTGSQKPFQCRICMRNFSRRQKLTIHTRTHTGEKPFQCRICMRNESHK SSLTRHLRTHLRGS |
| 87 | mRNA0051 | SRPGERPFQCRICMRNFSQQTNLTRHLRTHTGEKPFQCRICMRNFSANRTLVHH LKTHTGSQKPFQCRICMRNFSDPANLRRHTRTHTGEKPFQCRICMRNFSRQEHL VRHLRTHTGGGGSQKPFQCRICMRNFSMKHHLGRHLRTHTGEKPFQCRICMRNE SQNSHLRRHLKTHLRGS |
| 88 | mRNA0052 | SRPGERPFQCRICMRNFSQQTNLTRHLRTHTGEKPFQCRICMRNESANRTLVHH LKTHTGSQKPFQCRICMRNFSEEANLRRHTRTHTGEKPFQCRICMRNESRREHL VRHLRTHTGGGGSQKPFQCRICMRNFSMKHHLGRHLRTHTGEKPFQCRICMRNE SQNSHLRRHLKTHLRGS |
| 89 | mRNA0067 | SRPGERPFQCRICMRNFSQQTNLTRHLRTHTGEKPFQCRICMRNFSANRTLVHH LKTHTGSQKPFQCRICMRNFSDPANLRRHTRTHTGEKPFQCRICMRNESRQEHL VRHLRTHTGGGGSQKPFQCRICMRNFSLKQHLVRHLRTHTGEKPFQCRICMRNE SQGGHLARHLKTHLRGS |
| 90 | mRNA0068 | SRPGERPFQCRICMRNFSRNTHLARHTRTHTGEKPFQCRICMRNFSRADVLKGH LRTHTGSQKPFQCRICMRNFSQRSSLVRHLRTHTGEKPFQCRICMRNESRKDAL HVHLKTHTGGGGSQKPFQCRICMRNFSQNEHLKVHLRTHTGEKPFQCRICMRNE SQNSHLRRHLKTHLRGS |
| 91 | mRNA0053 | SRPGERPFQCRICMRNFSRNTHLARHTRTHTGEKPFQCRICMRNFSRADVLKGH LRTHTGSQKPFQCRICMRNFSQSSLVRHLRTHTGEKPFQCRICMRNESRKERL ATHLKTHTGGGGSQKPFQCRICMRNFSQKTHLAVHLRTHTGEKPFQCRICMRNE SQGGHLKRHLKTHLRGS |
| 92 | mRNA0054 | SRPGERPFQCRICMRNFSRNTHLARHTRTHTGEKPFQCRICMRNFSRADVLKGH LRTHTGSQKPFQCRICMRNESQSSSLVRHLRTHTGEKPFQCRICMRNESRKERL ATHLKTHTGGGGSQKPFQCRICMRNFSQKTHLAVHLRTHTGEKPFQCRICMRNE SQNSHLRRHLKTHLRGS |
| 93 | mRNA0055 | SRPGERPFQCRICMRNFSHKSSLTRHLRTHTGEKPFQCRICMRNESESGHLKRH LKTHTGSQKPFQCRICMRNFSRRRNLTLHTRTHTGEKPFQCRICMRNFSDRSSL KRHLRTHTGSQKPFQCRICMRNFSQPHSLAVHLRTHTGEKPFQCRICMRNESQK PHLSRHLKTHLRGS |
| 94 | mRNA0056 | SRPGERPFQCRICMRNFSHKSSLTRHLRTHTGEKPFQCRICMRNFSEGGHLKRH LKTHTGSQKPFQCRICMRNFSRRRNLQLHTRTHTGEKPFQCRICMRNESDHSSL KRHLRTHTGSQKPFQCRICMRNFSRRQHLQYHTRTHTGEKPFQCRICMRNESQS AHLKRHLRTHLRGS |
| 95 | mRNA0057 | SRPGERPFQCRICMRNFSHKSSLTRHLRTHTGEKPFQCRICMRNFSEGGHLKRH LKTHTGSQKPFQCRICMRNFSRRRNLTLHTRTHTGEKPFQCRICMRNESDRSSL KRHLRTHTGSQKPFQCRICMRNFSRRQHLQYHTRTHTGEKPFQCRICMRNFSQS AHLKRHLRTHLRGS |
| 96 | mRNA0058 | SRPGERPFQCRICMRNFSGHTALRNHTRTHTGEKPFQCRICMRNFSQSGTLHRH LRTHTGGGGSQKPFQCRICMRNFSDHSSLKRHLRTHTGEKPFQCRICMRNESAM RSLMGHLKTHTGSQKPFQCRICMRNFSRRSRLVRHTRTHTGEKPFQCRICMRNE SRGEHLTRHLRTHLRGS |
| 97 | mRNA0059 | SRPGERPFQCRICMRNFSGHTALRNHTRTHTGEKPFQCRICMRNFSQSTTLKRH LRTHTGGGGSQKPFQCRICMRNESDHSSLKRHLRTHTGEKPFQCRICMRNESQQ RSLVGHLKTHTGSQKPFQCRICMRNFSEAHHLSRHLRTHTGEKPFQCRICMRNE SRTEHLARHLKTHLRGS |
| 98 | mRNA0060 | SRPGERPFQCRICMRNFSGHTALRNHTRTHTGEKPFQCRICMRNFSQSTTLKRH LRTHTGGGGSQKPFQCRICMRNFSDHSSLKRHLRTHTGEKPFQCRICMRNESAM RSLMGHLKTHTGSQKPFQCRICMRNESRQSRLQRHTRTHTGEKPFQCRICMRNE SRREHLVRHLRTHLRGS |
| 99 | mRNA0062 | SRPGERPFQCRICMRNFSQGETLKRHLRTHTGEKPFQCRICMRNFSRADNLRRH LKTHTGSQKPFQCRICMRNFSDKANLTRHLRTHTGEKPFQCRICMRNFSDQGNL IRHLKTHTGGGGSQKPFQCRICMRNFSHRVLINHTRTHTGEKPFQCRICMRNE STNSSLTRHLRTHLRGS |
| 100 | mRNA0063 | SRPGERPFQCRICMRNFSQGETLKRHLRTHTGEKPFQCRICMRNESRADNLRRH LKTHTGSQKPFQCRICMRNFSDSSNLRRHLRTHTGEKPFQCRICMRNFSDQGNL IRHLKTHTGGGGSQKPFQCRICMRNFSHKSSLTRHLRTHTGEKPFQCRICMRNE SIRTSLKRHLKTHLRGS |

TABLE 18-continued

Sequence listing.

| SEQ | Description | Sequence |
|---|---|---|
| 101 | mRNA0069 | SRPGERPFQCRICMRNFSQGETLKRHLRTHTGEKPFQCRICMRNFSRADNLRRH LKTHTGSQKPFQCRICMRNFSEQGNLLRHLRTHTGEKPFQCRICMRNFSDGGNL GRHLKTHTGGGSQKPFQCRICMRNFSHRHVLINHTRTHTGEKPFQCRICMRNE STNSSLTRHLRTHLRGS |
| 102 | HBV target sequence | GATGAGGCATAGCAGCAG |
| 103 | HBV target sequence | GATGATTAGGCAGAGGTG |
| 104 | HBV target sequence | GGATTCAGCGCCGACGGG |
| 105 | HBV target sequence | GGCAGTAGTCGGAACAGGG |
| 106 | HBV target sequence | GTAAACTGAGCCAGGAGAA |
| 107 | HBV target sequence | ACGGTGGTCTCCATGCGAC |
| 108 | HBV target sequence | GCTGGATGTGTCTGCGGCG |
| 109 | HBV target sequence | GTCTGCGAGGCGAGGGAG |
| 110 | HBV target sequence | GTTGCCGGGCAACGGGGTA |
| 111 | HBV target sequence | CGAGAAAGTGAAAGCCTGC |
| 112 | HBV target sequence | GAGGCTTGAACAGTAGGAC |
| 113 | HBV target sequence | GAGGTTGGGGACTGCGAA |
| 114 | HBV target sequence | GATGATGTGGTATTGGGG |
| 115 | HBV target sequence | GATGATGTGGTATTGGGGG |
| 116 | HBV target sequence | GCAGTAGTCGGAACAGGG |
| 117 | HBV target sequence | GCATAGCAGCAGGATGAA |
| 118 | HBV target sequence | GGCGTTCACGGTGGTCTCC |
| 119 | HBV target sequence | GTTGGTGAGTGATTGGAG |
| 120 | HBV target sequence | GGAGGTTGGGGACTGCGAA |
| 121 | HBV target sequence | GGATGATGTGGTATTGGGG |
| 122 | HBV target sequence | GGATGTGTCTGCGGCGTT |
| 123 | HBV target sequence | GGGGGTTGCGTCAGCAAAC |
| 124 | HBV target sequence | GTTGTTAGACGACGAGGCA |
| 125 | F1 | KKENLLQ |

TABLE 18-continued

Sequence listing.

| SEQ | Description | Sequence |
|-----|-------------|----------|
| 126 | F1 | RRHILDR |
| 127 | F1 | RREVLEN |
| 128 | F1 | RRAVLDR |
| 129 | F1 | RQEHLVR |
| 130 | F1 | RREHLVR |
| 131 | F1 | KKDHLHR |
| 132 | F1 | KTDHLAR |
| 133 | F1 | QAGNLVR |
| 134 | F1 | QRGNLQR |
| 135 | F1 | DRGNLTR |
| 136 | F1 | RTDTLAR |
| 137 | F1 | RADNLGR |
| 138 | F1 | QQSSLLR |
| 139 | F1 | QASALSR |
| 140 | F1 | RGRNLEM |
| 141 | F1 | RRRNLDV |
| 142 | F1 | RGRNLAI |
| 143 | F1 | DGSNLRR |
| 144 | F1 | DPSNLQR |
| 145 | F1 | QQTNLTR |
| 146 | F1 | RATHLTR |
| 147 | F1 | RVDHLHR |
| 148 | F1 | RKHHLGR |
| 149 | F1 | DKSSLRK |
| 150 | F1 | CNGSLKK |
| 151 | F1 | TNNNLAR |
| 152 | F1 | RNTHLAR |
| 153 | F1 | HKSSLTR |
| 154 | F1 | GHTALRN |
| 155 | F1 | QGETLKR |
| 156 | F2 | RQDNLNS |
| 157 | F2 | RKDYLIS |
| 158 | F2 | RQDNLGR |
| 159 | F2 | RRDNLNR |
| 160 | F2 | EGGNLMR |
| 161 | F2 | DPSNLQR |
| 162 | F2 | DMGNLGR |
| 163 | F2 | QKEILTR |

TABLE 18-continued

Sequence listing.

| SEQ | Description | Sequence |
|-----|-------------|----------|
| 164 | F2 | QNSHLRR |
| 165 | F2 | QTTHLSR |
| 166 | F2 | QARSLRA |
| 167 | F2 | RTDSLPR |
| 168 | F2 | RLDMLAR |
| 169 | F2 | RNTHLSY |
| 170 | F2 | RREHLVR |
| 171 | F2 | DSSVLRR |
| 172 | F2 | RIDNLDG |
| 173 | F2 | RRDNLPK |
| 174 | F2 | ANRTLVH |
| 175 | F2 | RADVLKG |
| 176 | F2 | RKESLTV |
| 177 | F2 | RREHLSG |
| 178 | F2 | RREHLTI |
| 179 | F2 | RSDHLSL |
| 180 | F2 | VGGNLAR |
| 181 | F2 | VGGNLSR |
| 182 | F2 | DHSSLKR |
| 183 | F2 | RTDSLTL |
| 184 | F2 | ESGHLKR |
| 185 | F2 | EGGHLKR |
| 186 | F2 | QSGTLHR |
| 187 | F2 | QSTTLKR |
| 188 | F2 | RADNLRR |
| 189 | F3 | RSHNLKL |
| 190 | F3 | RSHNLRL |
| 191 | F3 | QSTTLKR |
| 192 | F3 | SDRRDLD |
| 193 | F3 | QSAHLKR |
| 194 | F3 | DLSTLRR |
| 195 | F3 | DGSTLRR |
| 196 | F3 | EKASLIK |
| 197 | F3 | DKSSLRK |
| 198 | F3 | CNGSLKK |
| 199 | F3 | DHSSLKR |
| 200 | F3 | RGDGLRR |
| 201 | F3 | RKLGLLR |

TABLE 18-continued

Sequence listing.

| SEQ | Description | Sequence |
|---|---|---|
| 202 | F3 | GLTALRT |
| 203 | F3 | QNANLKR |
| 204 | F3 | LKSNLHR |
| 205 | F3 | QRRYLVE |
| 206 | F3 | TTENLRV |
| 207 | F3 | EEANLRR |
| 208 | F3 | QRSSLVR |
| 209 | F3 | QSSSLVR |
| 210 | F3 | KRYNLYQ |
| 211 | F3 | KKENLLQ |
| 212 | F3 | RNFILQR |
| 213 | F3 | RNFILAR |
| 214 | F3 | QREHLTT |
| 215 | F3 | QREHLNG |
| 216 | F3 | DPANLRR |
| 217 | F3 | RRRNLTL |
| 218 | F3 | RRRNLQL |
| 219 | F3 | DKANLTR |
| 220 | F3 | DSSNLRR |
| 221 | F3 | EQGNLLR |
| 222 | F4 | QSTTLKR |
| 223 | F4 | RRDGLAG |
| 224 | F4 | SFQSYLE |
| 225 | F4 | ETGSLRR |
| 226 | F4 | DRTPLNR |
| 227 | F4 | QNEHLKV |
| 228 | F4 | QKTHLAV |
| 229 | F4 | DHSSLKR |
| 230 | F4 | QPHGLAH |
| 231 | F4 | QPHGLRH |
| 232 | F4 | QPHGLST |
| 233 | F4 | RRDNLNR |
| 234 | F4 | RQDNLGR |
| 235 | F4 | ERAKLIR |
| 236 | F4 | QKHHLAV |
| 237 | F4 | LKQHLVV |
| 238 | F4 | QQTNLAR |
| 239 | F4 | QTQNLTR |

TABLE 18-continued

Sequence listing.

| SEQ | Description | Sequence |
|---|---|---|
| 240 | F4 | RGEHLTR |
| 241 | F4 | RREHLVR |
| 242 | F4 | RKDALHV |
| 243 | F4 | RKERLAT |
| 244 | F4 | DPTSLNR |
| 245 | F4 | RQDNLNT |
| 246 | F4 | RRDNLKS |
| 247 | F4 | RNDTLII |
| 248 | F4 | RQDILVV |
| 249 | F4 | RGDNLKR |
| 250 | F4 | RGDNLAR |
| 251 | F4 | RQEHLVR |
| 252 | F4 | DRSSLKR |
| 253 | F4 | AMRSLMG |
| 254 | F4 | QQRSLVG |
| 255 | F4 | DQGNLIR |
| 256 | F4 | DGGNLGR |
| 257 | F5 | RNTNLTR |
| 258 | F5 | RQDNLGR |
| 259 | F5 | VHHNLVR |
| 260 | F5 | RPNHLAI |
| 261 | F5 | QSHSLKS |
| 262 | F5 | QKHHLVT |
| 263 | F5 | GGTALRM |
| 264 | F5 | GGSALSM |
| 265 | F5 | RRFILSR |
| 266 | F5 | RNFILQR |
| 267 | F5 | QSAHLKR |
| 268 | F5 | QQAHLVR |
| 269 | F5 | RARNLTL |
| 270 | F5 | RRRNLQL |
| 271 | F5 | AKRDLDR |
| 272 | F5 | LRKDLVR |
| 273 | F5 | QRSNLAR |
| 274 | F5 | LKTNLAR |
| 275 | F5 | QRSDLTR |
| 276 | F5 | HKETLNR |
| 277 | F5 | TNSSLTR |

TABLE 18-continued

Sequence listing.

| SEQ | Description | Sequence |
|---|---|---|
| 278 | F5 | MTSSLRR |
| 279 | F5 | VRHNLTR |
| 280 | F5 | VAHNLTR |
| 281 | F5 | QSSSLVR |
| 282 | F5 | RSHNLKL |
| 283 | F5 | RSHNLRL |
| 284 | F5 | TSTLLKR |
| 285 | F5 | HKSSLTR |
| 286 | F5 | RRQKLTI |
| 287 | F5 | MKHHLGR |
| 288 | F5 | LKQHLVR |
| 289 | F5 | QNEHLKV |
| 290 | F5 | QKTHLAV |
| 291 | F5 | QPHSLAV |
| 292 | F5 | RRQHLQY |
| 293 | F5 | RRSRLVR |
| 294 | F5 | EAHHLSR |
| 295 | F5 | RQSRLQR |
| 296 | F5 | HRHVLIN |
| 297 | F6 | IKHNLAR |
| 298 | F6 | VVNNLNR |
| 299 | F6 | ISHNLAR |
| 300 | F6 | QSPHLKR |
| 301 | F6 | ESGHLKR |
| 302 | F6 | ENSKLRR |
| 303 | F6 | QRSSLVR |
| 304 | F6 | RNDSLKC |
| 305 | F6 | RNDTLII |
| 306 | F6 | VGNSLSR |
| 307 | F6 | VHESLKR |
| 308 | F6 | DPSSLKR |
| 309 | F6 | DHSSLKR |
| 310 | F6 | VNSSLTR |
| 311 | F6 | VRHSLTR |
| 312 | F6 | QKVHLEA |
| 313 | F6 | QKCHLKA |
| 314 | F6 | RGDNLNR |
| 315 | F6 | REDNLGR |

TABLE 18-continued

Sequence listing.

| SEQ | Description | Sequence |
|---|---|---|
| 316 | F6 | RIDNLIR |
| 317 | F6 | RQDNLGR |
| 318 | F6 | QTNTLGR |
| 319 | F6 | QGGTLRR |
| 320 | F6 | QSTTLKR |
| 321 | F6 | LKEHLTR |
| 322 | F6 | HKSSLTR |
| 323 | F6 | QNSHLRR |
| 324 | F6 | QGGHLAR |
| 325 | F6 | QGGHLKR |
| 326 | F6 | QKPHLSR |
| 327 | F6 | QSAHLKR |
| 328 | F6 | RGEHLTR |
| 329 | F6 | RTEHLAR |
| 330 | F6 | RREHLVR |
| 331 | F6 | TNSSLTR |
| 332 | F6 | IRTSLKR |
| 327 | F6 | QSAHLKR |
| 328 | F6 | RGEHLTR |
| 329 | F6 | RTEHLAR |
| 330 | F6 | RREHLVR |
| 331 | F6 | TNSSLTR |
| 332 | F6 | IRTSLKR |
| 495 | ZIM3 | MNNSQGRVTFEDVTVNFTQGEWQRLNPEQRNLYRDVMLENYSNLVSVGQGETTK PDVILRLEQGKEPWLEEEEVLGSGRAEKNGDIGGQIWKPKDVKESL |
| 496 | ZNF436 | MAATLLMAGSQAPVTFEDMAMYLTREEWRPLDAAQRDLYRDVMQENYGNVVSLD FEIRSENEVNPKQEISEDVQFGTTSERPAENAEENPESEEGFESGDRSERQW |
| 497 | ZNF257 | MLENYRNLVFLGIAVSKPDLITCLEQGKEPCNMKRHEMVAKPPVMCSHIAEDLC PERDIKYFFQKVILRRYDKCEHENLQLRKGCKSVDECKVCK |
| 498 | ZNF675 | MGLLTERDVAIEFSLEEWQCLDTAQRNLYKNVILENYRNLVELGIAVSKQDLIT CLEQEKEPLTVKRHEMVNEPPVMCSHFAQEFWPEQNIKDSF |
| 499 | ZNF490 | MLQMQNSEHHGQSIKTQTDSISLEDVAVNFTLEEWALLDPGQRNIYRDVMRATE KNLACIGEKWKDQDIEDEHKNQGRNLRSPMVEALCENKEDCPCGKSTSQIPDLN TNLETPTG |
| 500 | ZNF320 | MALSQGLLTFRDVAIEFSQEEWKCLDPAQRTLYRDVMLENYRNLVSLDISSKCM MNTLSSTGQGNTEVIHTGTLQRQASYHIGAFCSQEIEKDIHDFVFQ |
| 501 | ZNF331 | MAQGLVTFADVAIDFSQEEWACLNSAQRDLYWDVMLENYSNLVSLDLESAYENK SLPTKKNIHEIRASKRNSDRRSKSLGRNWICEGTLERPQRSRGR |
| 502 | ZNF816 | MLREEATKKSKEKEPGMALPQGRLTERDVAIEFSLEEWKCLNPAQRALYRAVML ENYRNLEFVDSSLKSMMEFSSTRHSITGEVIHTGTLQRHKSHHIGDFCFPEMKK DIHHFEFQWQ |
| 503 | ZNF680 | MPGPPGSLEMGPLTFRDVAIEFSLEEWQCLDTAQRNLYRKVMFENYRNLVFLGI AVSKPHLITCLEQGKEPWNRKRQEMVAKPPVIYSHFTEDLWPEHSIKDSF |

TABLE 18-continued

Sequence listing.

| SEQ | Description | Sequence |
|---|---|---|
| 504 | ZNF41 | MSPPWSPALAAEGRGSSCEASVSFEDVTVDESKEEWQHLDPAQRRLYWDVTLEN YSHLLSVGYQIPKSEAAFKLEQGEGPWMLEGEAPHQSCSGEAIGKMQQQGIPGG IFFHC |
| 505 | ZNF189 | MASPSPPPESKEEWDYLDPAQRSLYKDVMMENYGNLVSLDVLNRDKDEEPTVKQ EIEEIEEEVEPQGVIVTRIKSEIDQDPMGRETFELVGRLDKQRGIFLWEIPRES L |
| 506 | ZNF528 | MALTQGPLKFMDVAIEFSQEEWKCLDPAQRTLYRDVMLENYRNLVSLGICLPDL SVTSMLEQKRDPWTLQSEEKIANDPDGRECIKGVNTERSSKLGSN |
| 507 | ZNF543 | MAASAQVSVTFEDVAVTFTQEEWGQLDAAQRTLYQEVMLETCGLLMSLGCPLEK PELIYQLDHRQELWMATKDLSQSSYPGDNTKPKTTEPTFSHLALPE |
| 508 | ZNF554 | MFSQEERMAAGYLPRWSQELVTFEDVSMDESQEEWELLEPAQKNLYREVMLENY RNVVSLEALKNQCTDVGIKEGPLSPAQTSQVTSLSSWTGYLLFQPVASSHLEQR EALWIEEKGTPQASCSDWMTVLRNQDSTYKKVALQE |
| 509 | ZNF140 | MSQGSVTFRDVAIDESQEEWKWLQPAQRDLYRCVMLENYGHLVSLGLSISKPDV VSLLEQGKEPWLGKREVKRDLFSVSESSGEIKDESPKNVIYDD |
| 510 | ZNF610 | MEEAQKRKAKESGMALPQGRLTEMDVAIEFSQEEWKSLDPGQRALYRDVMLENY RNLVFLGRSCVLGSNAENKPIKNQLGLTLESHLSELQLFQAGRKIYRSNQVEKE TNHR |
| 511 | ZNF264 | MAAAVLTDRAQVSVTFDDVAVTFTKEEWGQLDLAQRTLYQEVMLENCGLLVSLG CPVPKAELICHLEHGQEPWTRKEDLSQDTCPGDKGKPKTTEPTTCEPALSE |
| 512 | ZNF350 | MIQAQESITLEDVAVDFTWEEWQLLGAAQKDLYRDVMLENYSNLVAVGYQASKP DALFKLEQGEQLWTIEDGIHSGACSDIWKVDHVLERLQSESLVNR |
| 513 | ZNF8 | MEGVAGVMSVGPPAARLQEPVTFRDVAVDFTQEEWGQLDPTQRILYRDVMLETF GHLLSIGPELPKPEVISQLEQGTELWVAERGTTQGCHPAWEPRSESQASRKEEG LPEE |
| 514 | ZNF582 | MSLGSELFRDVAIVFSQEEWQWLAPAQRDLYRDVMLETYSNLVSLGLAVSKPDV ISFLEQGKEPWMVERVVSGGLCPVLESRYDTKELFPKQHVYEV |
| 515 | ZNF30 | MAHKYVGLQYHGSVTFEDVAIAFSQQEWESLDSSQRGLYRDVMLENYRNLVSMA GHSRSKPHVIALLEQWKEPEVTVRKDGRRWCTDLQLEDDTIGCKEMPTSEN |
| 516 | ZNF324 | MAFEDVAVYFSQEEWGLLDTAQRALYRRVMLDNFALVASLGLSTSRPRVVIQLE RGEEPWVPSGTDTTLSRTTYRRRNPGSWSLTEDRDVSG |
| 517 | ZNF98 | MLENYRNLVFVGIAASKPDLITCLEQGKEPWNVKRHEMVTEPPVVYSYFAQDLW PKQGKKNYFQKVILRTYKKCGRENLQLRKYCKSMDECKVHKECYNGLNQC |
| 518 | ZNF669 | MHERRPDPCREPLASPIQDSVAFEDVAVNETQEEWALLDSSQKNLYREVMQETC RNLASVGSQWKDQNIEDHFEKPGKDIRNHIVQRLCESKEDGQYGEVVSQIPNLD LNENISTGLKPCECSICGK |
| 519 | ZNF677 | MALSQGLFTFKDVAIEFSQEEWECLDPAQRALYRDVMLENYRNLLSLDEDNIPP EDDISVGFTSKGLSPKENNKEELYHLVILERKESHGINNFDLKEVWENMPKEDS LW |
| 520 | ZNF596 | MTFEDIIVDETQEEWALLDTSQRKLFQDVMLENISHLVSIGKQLCKSVVLSQLE QVEKLSTQRISLLQGREVGIKHQEIPFIHHIYQKGTSTISTMRS |
| 521 | ZNF214 | MAVTFEDVTIIFTWEEWKFLDSSQKRLYREVMWENYTNVMSVENWNESYKSQEE KFRYLEYENFSYWQGWWNAGAQMYENQNYGETVQGTDSKDLTQQDRSQC |
| 522 | ZNF37A | MITSQGSVSFRDVTVGFTQEEWQHLDPAQRTLYRDVMLENYSHLVSVGYCIPKP EVILKLEKGEEPWILEEKFPSQSHLELINTSRNYSIMKENEENKG |
| 523 | ZNF34 | MFEDVAVYLSREEWGRLGPAQRGLYRDVMLETYGNLVSLGVGPAGPKPGVISQL ERGDEPWVLDVQGTSGKEHLRVNSPALGTRTEYKELTSQETFGEEDPQGSEPVE ACDHIS |
| 524 | ZNF250 | METYGNVVSLGLPGSKPDIISQLERGEDPWVLDRKGAKKSQGLWSDYSDNLKYD HTTACTQQDSLSCPWECETKGESQNTDLSPKPLISEQTVILGKTPLGRIDQENN ETKQ |
| 525 | ZNF547 | MAEMNPAQGHVVFEDVAIYESQEEWGHLDEAQRLLYRDVMLENLALLSSLGCCH GAEDEEAPLEPGVSVGVSQVMAPKPCLSTQNTQPCETCSSLLKDILRL |

TABLE 18-continued

Sequence listing.

| SEQ | Description | Sequence |
|---|---|---|
| 526 | ZNF273 | MLDNYRNLVFLGIAVSKPDLITCLEQGKEPCNMKRHAMVAKPPVVCSHFAQDLW PKQGLKDS |
| 527 | ZNF354A | MAAGQREARPQVSLTFEDVAVLFTRDEWRKLAPSQRNLYRDVMLENYRNLVSLG LPFTKPKVISLLQQGEDPWEVEKDGSGVSSLGSKSSHKTTKSTQTQDSSFQ |
| 528 | ZFP82 | MALRSVMESDVSIDESPEEWEYLDLEQKDLYRDVMLENYSNLVSLGCFISKPDV ISSLEQGKEPWKVVRKGRRQYPDLETKYETKKLSLENDIYEIN |
| 529 | ZNF224 | MTTFKEAMTFKDVAVVFTEEELGLLDLAQRKLYRDVMLENERNLLSVGHQAFHR DTFHELREEKIWMMKTAIQREGNSGDKIQTEMETVSEAGTHQEW |
| 530 | ZNF33A | MFQVEQKSQESVSFKDVTVGETQEEWQHLDPSQRALYRDVMLENYSNLVSVGYC VHKPEVIFRLQQGEEPWKQEEEFPSQSFPEVWTADHLKERSQENQSKHL |
| 531 | ZNF45 | MTKSKEAVTFKDVAVVFSEEELQLLDLAQRKLYRDVMLENFRNVVSVGHQSTPD GLPQLEREEKLWMMKMATQRDNSSGAKNLKEMETLQEVGLRYLP |
| 532 | ZNF175 | MSQKPQVLGPEKQDGSCEASVSFEDVTVDESREEWQQLDPAQRCLYRDVMLELY SHLFAVGYHIPNPEVIFRMLKEKEPRVEEAEVSHQRCQEREFGLEIPQKEISKK ASFQ |
| 533 | ZNF595 | MELVTFRDVAIEFSPEEWKCLDPAQQNLYRDVMLENYRNLVSLGFVISNPDLVT CLEQIKEPCNLKIHETAAKPPAICSPFSQDLSPVQGIEDSE |
| 534 | ZNF184 | MSTLLQGGHNLLSSASFQESVTFKDVIVDFTQEEWKQLDPGQRDLERDVTLENY THLVSIGLQVSKPDVISQLEQGTEPWIMEPSIPVGTCADWETRLENSVSAPEPD ISEE |
| 535 | ZNF419 | MDPAQVPVAADLLTDHEEGYVTFEDVAVYFSQEEWRLLDDAQRLLYRNVMLENE TLLASLGLASSKTHEITQLESWEEPFMPAWEVVTSAIPRGCWHGAEAEEAPEQI ASVG |
| 536 | ZFP28-1 | MKKLEAVGTGIEPKAMSQGLVTFGDVAVDESQEEWEWLNPIQRNLYRKVMLENY RNLASLGLCVSKPDVISSLEQGKEPWTVKRKMTRAWCPDLKAVWKIKELPLKKD FCEG |
| 537 | ZFP28-2 | MSLLGEHWDYDALFETQPGLVTIKNLAVDERQQLHPAQKNFCKNGIWENNSDLG SAGHCVAKPDLVSLLEQEKEPWMVKRELTGSLFSGQRSVHETQELFPKQDSYAE |
| 538 | ZNF18 | MLALAASQPARLEERLIRDRDLGASLLPAAPQEQWRQLDSTQKEQYWDLILETY GKMVSGAGISHPKSDLTNSIEFGEELAGIYLHVNEKIPRPTCIGDRQENDKENL NLENH |
| 539 | ZNF213 | MEGRPGETTDTCFVSGVHGPVALGDIPFYFSREEWGTLDPAQRDLEWDIKRENS RNTTLGFGLKGQSEKSLLQEMVPVVPGQTGSDVTVSWSPEEAEAWESENRPRAA LGPVVGARRGRPPTRRRQFRDLA |
| 540 | ZNF394 | MVAVVRALQRALDGTSSQGMVTFEDTAVSLTWEEWERLDPARRDFCRESAQKDS GSTVPPSLESRVENKELIPMQQILEEAEPQGQLQEAFQGKRPLESKCGSTHEDR VEKQSGDP |
| 541 | ZFP1 | MNKSQGSVSFTDVTVDFTQEEWEQLDPSQRILYMDVMLENYSNLLSVEVWKADD QMERDHRNPDEQARQFLILKNQTPIEERGDLFGKALNLNTDFVSLRQVPYKYDL YEKTL |
| 542 | ZFP14 | MAHGSVTFRDVAIDESQEEWEFLDPAQRDLYRDVMWENYSNFISLGPSISKPDV ITLLDEERKEPGMVVREGTRRYCPDLESRYRTNTLSPEKDIYEIYSFQWDIMER |
| 543 | ZNF416 | MAAAVLRDSTSVPVTAEAKLMGFTQGCVTFEDVAIYFSQEEWGLLDEAQRLLYR DVMLENFALITALVCWHGMEDEETPEQSVSVEGVPQVRTPEASPSTQKIQSCDM CVPFLTDILHLTDLPGQELYLTGACAVEHQDQK |
| 544 | ZNF557 | MLPPTAASQREGHTEGGELVNELLKSWLKGLVTFEDVAVEFTQEEWALLDPAQR TLYRDVMLENCRNLASLGNQVDKPRLISQLEQEDKVMTEERGILSGTCPDVENP FKAKGLTPKLHVERKEQSRNMKMER |
| 545 | ZNF566 | MAQESVMFSDVSVDESQEEWECLNDDQRDLYRDVMLENYSNLVSMGHSISKPNV ISYLEQGKEPWLADRELTRGQWPVLESRCETKKLELKKEIYEIESTQWEIMEK |
| 546 | ZNF729 | MPGAPGSLEMGPLTFRDVTIEFSLEEWQCLDTVQQNLYRDVMLENYRNLVELGM AVFKPDLITCLKQGKEPWNMKRHEMVTKPPVMRSHFTQDLWPDQSTKDSFQEVI LRTYAR |
| 547 | ZIM2 | MAGSQFPDFKHLGTFLVFEELVTFEDVLVDESPEELSSLSAAQRNLYREVMLEN YRNLVSLGHQFSKPDIISRLEEEESYAMETDSRHTVICQGE |

TABLE 18-continued

Sequence listing.

| SEQ | Description | Sequence |
|---|---|---|
| 548 | ZNF254 | MPGPPRSLEMGLLTFRDVAIEFSLEEWQHLDIAQQNLYRNVMLENYRNLAFLGI AVSKPDLITCLEQGKEPWNMKRHE |
| 549 | ZNF764 | MAPPLAPLPPRDPNGAGPEWREPGAVSFADVAVYFCREEWGCLRPAQRALYRDV MRETYGHLSALGIGGNKPALISWVEEEAELWGPAAQDPE |
| 550 | ZNF785 | MGPPLAPRPAHVPGEAGPRRTRESRPGAVSFADVAVYESPEEWECLRPAQRALY RDVMRETFGHLGALGFSVPKPAFISWVEGEVEAWSPEAQDPDGESS |
| 551 | ZNF10 (KOX1) | MDAKSLTAWSRTLVTFKDVFVDFTREEWKLLDTAQQIVYRNVMLENYKNLVSLG YQLTKPDVILRLEKGEEPWLVEREIHQETHPDSETAFEIKSSVSSRSIFKDKQS CDIKMEGMARNDLWYLSLEEVWKCRDQLDKYQENPERHLRQVAFTQKKVLTQER VSESGKYGGNCLLPAQLVLREYFHKRDSHTKSLKHDLVLNGHQDSCASNSNECG QTFCQNIHLIQFARTHTGDKSYKCPDNDNSLTHGSSLGISKGIHREKPYECKEC GKFFSWRSNLTRHQLIHTGEKPYECKECGKSFSRSSHLIGHQKTHTGEEPYECK ECGKSFSWFSHLVTHQRTHTGDKLYTCNQCGKSFVHSSRLIRHQRTHTGEKPYE CPECGKSFRQSTHLILHQRTHVRVRPYECNECGKSYSQRSHLVVHHRIHTGLKP FECKDCGKCFSRSSHLYSHQRTHTGEKPYECHDCGKSFSQSSALIVHQRIHTGE KPYECCQCGKAFIRKNDLIKHQRIHVGEETYKCNQCGIIFSQNSPPIVHQIAHT GEQFLTCNQCGTALVNTSNLIGYQTNHIRENAY |
| 552 | CBX5 (chromoshadow domain) | MGKKTKRTADSSSEDEEEYVVEKVLDRRVVKGQVEYLLKWKGESEEHNTWEPE KNLDCPELISEFMKKYKKMKEGENNKPREKSESNKRKSNESNSADDIKSKKKRE QSNDIARGFERGLEPEKIIGATDSCGDLMFLMKWKDTDEADLVLAKEANVKCPQ IVIAFYEERLTWHAYPEDAENKEKETAKS |
| 553 | RYBP (YAF2_RYBP component of PRC1) | MTMGDKKSPTRPKRQAKPAADEGFWDCSVCTERNSAEAFKCSICDVRKGTSTRK PRINSQLVAQQVAQQYATPPPPKKEKKEKVEKQDKEKPEKDKEISPSVTKKNTN KKTKPKSDILKDPPSEANSIQSANATTKTSETNHTSRPRLKNVDRSTAQQLAVT VGNVTVIITDFKEKTRSSSTSSSTVTSSAGSEQQNQSSSGSESTDKGSSRSSTP KGDMSAVNDESF |
| 554 | YAF2 (YAF2_RYBP component of PRC1) | MGDKKSPTRPKRQPKPSSDEGYWDCSVCTERNSAEAFKCMMCDVRKGTSTRKPR PVSQLVAQQVTQQFVPPTQSKKEKKDKVEKEKSEKETTSKKNSHKKTRPRLKNV DRSSAQHLEVTVGDLTVIITDFKEKTKSPPASSAASADQHSQSGSSSDNTERGM SRSSSPRGEASSLNGESH |
| 555 | MGA (component of PRC1.6) | MEEKQQIILANQDGGTVAGAAPTFFVILKQPGNGKTDQGILVTNQDACALASSV SSPVKSKGKICLPADCTVGGITVTLDNNSMWNEFYHRSTEMILTKQGRRMFPYC RYWITGLDSNLKYILVMDISPVDNHRYKWNGRWWEPSGKAEPHVLGRVFIHPES PSTGHYWMHQPVSFYKLKLTNNTLDQEGHIILHSMHRYLPRLHLVPAEKAVEVI QLNGPGVHTFTFPQTEFFAVTAYQNIQITQLKIDYNPFAKGERDDGLNNKPQRD GKQKNSSDQEGNNISSSSGHRVRLTEGQGSEIQPGDLDPLSRGHETSGKGLEKT SLNIKRDELGEMDTDSALSEVPQLKQEISECLIASSFEDDSRVASPLDQNGSEN VVIKEEPLDDYDYELGECPEGVTVKQEETDEETDVYSNSDDDPILEKQLKRHNK VDNPEADHLSSKWLPSSPSGVAKAKMEKLDTGKMPVVYLEPCAVTRSTVKISEL PDNMLSTSRKDKSSMLAELEYLPTYIENSNETAFCLGKESENGLRKHSPDLRVV QKYPLLKEPQWKYPDISDSISTERILDDSKDSVGDSLSGKEDLGRKRTTMLKIA TAAKVVNANQNASPNVPGKRGRPRKLKLCKAGRPPKNTGKSLISTKNTPVSPGS TFPDVKPDLEDVDGVLEVSFESKEALDIHAVDGTTEESSSLQASTTNDSGYRAR ISQLEKELIEDLKTLRHKQVIHPGLQEVGLKLNSVDPTMSIDLKYLGVQLPLAP ATSFPPWNLTGTNPASPDAGFPFVSRTGKINDFTKIKGWRGKFHSASASRNEGG NSESSSLKNRSAFCSDKLDEYLENEGKLMETSMGFSSNAPTSPVVYQLPTKSTY VRTLDSVLKKQSTISPSTSYSLKPHSVPPVSRKAKSQNRQATFSGRTKSSYKSI LPYPVSPKQKYSHVILGDKVTKNSSGIISENQANNFVVPTLDENIFPKQISLRQ AQQQQQQQQGSRPPGLSKSQVKLMDLEDCALWEGKPRTYITEERADVSLTTLLT AQASLKTKPIHTIIRKRAPPCNNDFCRLGCVCSSLALEKRQPAHCRRPDCMFGC TCLKRKVVLVKGGSKTKHFQRKAAHRDPVFYDTLGEEAREEEEGIREEEEQLKE KKKRKKLEYTICETEPEQPVRHYPLWVKVEGEVDPEPVYIPTPSVIEPMKPLLL PQPEVLSPTVKGKLLTGIKSPRSYTPKPNPVIREEDKDPVYLYFESMMTCARVR VYERKKEDQRQPSSSSSPSFQQQTSCHSSPENHNNAKEPDSEQQPLKQLTCD LEDDSDKLQEKSWKSSCNEGESSSTSYMHQRSPGGPTKLIEIISDCNWEEDRNK ILSILSQHINSNMPQSLKVGSFIIELASQRKSRGEKNPPVYSSRVKISMPSCQD QDDMAEKSGSETPDGPLSPGKMEDISPVQTDALDSVRERLHGGKGLPFYAGLSP AGKLVAYKRKPSSSTSGLIQVASNAKVAASRKPRTLLPSTSNSKMASSSGTATN RPGKNLKAFVPAKRPIAARPSPGGVFTQFVMSKVGALQQKIPGVSTPQTLAGTQ KFSIRPSPVMVVTPVVSSEPVQVCSPVTAAVTTTTPQVELENTTAVTPMTAISD VETKETTYSSGATTTGVVEVSETNTSTSVTSTQSTATVNLTKTTGITTPVASVA FPKSLVASPSTITLPVASTASTSLVVVTAAASSSMVTTPTSSLGSVPIILSGIN GSPPVSQRPENAAQIPVATPQVSPNTVKRAGPRLLLIPVQQGSPTLRPVSNTQL QGHRMVLQPVRSPSGMNLFRHPNGQIVQLLPLHQLRGSNTQPNLQPVMERNPGS VMGIRLPAPSKPSETPPSSTSSSAFSVMNPVIQAVGSSSAVNVITQAPSLLSSG ASFVSQAGTLTLRISPPEPQSFASKTGSETKITYSSGGQPVGTASLIPLQSGSF ALLQLPGQKPVPSSILQHVASLQMKRESQNPDQKDETNSIKREQETKKVLQSEG EAVDPEANVIKQNSGAATSEETLNDSLEDRGDHLDEECLPEEGCATVKPSEHSC |

TABLE 18-continued

Sequence listing.

| SEQ | Description | Sequence |
|---|---|---|
| | | ITGSHTDQDYKDVNEEYGARNRKSSKEKVAVLEVRTISEKASNKTVQNLSKVQH<br>QKLGDVKVEQQKGFDNPEENSSEFPVTEKEESKFELSGSKVMEQQSNLQPEAKE<br>KECGDSLEKDRERWRKHLKGPLTRKCVGASQECKKEADEQLIKETKTCQENSDV<br>FQQEQGISDLLGKSGITEDARVLKTECDSWSRISNPSAFSIVPRRAAKSSRGNG<br>HFQGHLLLPGEQIQPKQEKKGGRSSADFTVLDLEEDDEDDNEKTDDSIDEIVDV<br>VSDYQSEEVDDVEKNNCVEYIEDDEEHVDIETVEELSEEINVAHLKTTAAHTQS<br>FKQPSCTHISADEKAAERSRKAPPIPLKLKPDYWSDKLQKEAEAFAYYRRTHTA<br>NERRRRGEMRDLFEKLKITLGLLHSSKVSKSLILTRAFSEIQGLTDQADKLIGQ<br>KNLLTRKRNILIRKVSSLSGKTEEVVLKKLEYIYAKQQALEAQKRKKKMGSDEF<br>DISPRISKQQEGSSASSVDLGQMFINNRRGKPLILSRKKDQATENTSPLNTPHT<br>SANLVMTPQGQLLTLKGPLFSGPVVAVSPDLLESDLKPQVAGSAVALPENDDLE<br>MMPRIVNVTSLATEGGLVDMGGSKYPHEVPDSKPSDHLKDTVRNEDNSLEDKGR<br>ISSRGNRDGRVTLGPTQVFLANKDSGYPQIVDVSNMQKAQEFLPKKISGDMRGI<br>QYKWKESESRGERVKSKDSSFHKLKMKDLKDSSIEMELRKVTSAIEEAALDSSE<br>LLTNMEDEDDTDETLTSLLNEIAFLNQQLNDDSVGLAELPSSMDTEFPGDARRA<br>FISKVPPGSRATFQVEHLGTGLKELPDVQGESDSISPLLLHLEDDDESENEKQL<br>AEPASEPDVLKIVIDSEIKDSLLSNKKAIDGGKNTSGLPAEPESVSSPPTLHMK<br>TGLENSNSTDTLWRPMPKLAPLGLKVANPSSDADGQSLKVMPCLAPIAAKVGSV<br>GHKMNLTGNDQEGRESKVMPTLAPVVAKLGNSGASPSSAGK |
| 556 | CBX1<br>(chromoshadow) | MGKKQNKKKVEEVLEEEEEEYVVEKVLDRRVVKGKVEYLLKWKGFSDEDNTWEP<br>EENLDCPDLIAEFLQSQKTAHETDKSEGGKRKADSDSEDKGEESKPKKKKEESE<br>KPRGFARGLEPERIIGATDSSGELMFLMKWKNSDEADLVPAKEANVKCPQVVIS<br>FYEERLTWHSYPSEDDDKKDDKN |
| 557 | SCMH1<br>(SAM_1/SPM) | MLVCYSVLACEILWDLPCSIMGSPLGHFTWDKYLKETCSVPAPVHCFKQSYTPP<br>SNEFKISMKLEAQDPRNTTSTCIATVVGLTGARLRLRLDGSDNKNDFWRLVDSA<br>EIQPIGNCEKNGGMLQPPLGFRLNASSWPMFLLKTLNGAEMAPIRIFHKEPPSP<br>SHNFFKMGMKLEAVDRKNPHFICPATIGEVRGSEVLVTFDGWRGAFDYWCRFDS<br>RDIFPVGWCSLTGDNLQPPGTKVVIPKNPYPASDVNTEKPSIHSSTKTVLEHQP<br>GQRGRKPGKKRGRTPKTLISHPISAPSKTAEPLKFPKKRGPKPGSKRKPRTLLN<br>PPPASPTTSTPEPDTSTVPQDAATIPSSAMQAPTVCIYLNKNGSTGPHLDKKKV<br>QQLPDHFGPARASVVLQQAVQACIDCAYHQKTVESFLKQGHGGEVISAVEDREQ<br>HTLNLPAVNSITYVLRFLEKLCHNLRSDNLFGNQPFTQTHLSLTAIEYSHSHDR<br>YLPGETFVLGNSLARSLEPHSDSMDSASNPTNLVSTSQRHRPLLSSCGLPPSTA<br>SAVRRLCSRGVLKGSNERRDMESFWKLNRSPGSDRYLESRDASRLSGRDPSSWT<br>VEDVMQFVREADPQLGPHADLFRKHEIDGKALLLLRSDMMMKYMGLKLGPALKL<br>SYHIDRLKQGKF |
| 558 | MPP8<br>(Chromodomain) | MEQVAEGARVTAVPVSAADSTEELAEVEEGVGVVGEDNDAAARGAEAFGDSEED<br>GEDVFEVEKILDMKTEGGKVLYKVRWKGYTSDDDTWEPEIHLEDCKEVLLEFRK<br>KIAENKAKAVRKDIQRLSLNNDIFEANSDSDQQSETKEDTSPKKKKKLRQREE<br>KSPDDLKKKKAKAGKLKDKSKPDLESSLESLVEDLRTKKRISEAKEELKESKKP<br>KKDEVKETKELKKVKKGEIRDLKTKTREDPKENRKTKKEKFVESQVESESSVLN<br>DSPFPEDDSEGLHSDSREEKQNTKSAREREAGQDMGLEHGFEKPLDSAMSAEEDT<br>DVRGRRKKKTPRKAEDTRENRKLENKNAFLEKKTVPKKQRNQDRSKSAAELEKL<br>MPVSAQTPKGRRLSGEERGLWSTDSAEEDKETKRNESKEKYQKRHDSDEEKGR<br>KEPKGLKTLKEIRNAFDLFKLTPEEKNDVSENNRKREEIPLDEKTIDDHKTKEN<br>KQSLKERRNTRDETDTWAYIAAEGDQEVLDSVCQADENSDGRQQILSLGMDLQL<br>EWMKLEDFQKHLDGKDENFAATDAIPSNVLRDAVKNGDYITTVKVALNSNEEYNL<br>DQEDSSGMTLVMLAAAGGQDDLLRLLITKGAKVNGRQKNGTTALIHAAEKNELT<br>TVAILLEAGAFVNVQQSNGETALMKACKRGNSDIVRLVIECGADCNILSKHQNS<br>ALHFAKQSNNVLVYDLLKNHLETLSRVAEETIKDYFEARLALLEPVFPIACHRL<br>CEGPDFSTDENYKPPQNIPEGSGILLFIFHANFLGKEVIARLCGPCSVQAVVLN<br>DKFQLPVELDSHFVYSFSPVAGPNKLFIRLTEAPSAKVKLLIGAYRVQLQ |
| 559 | SUMO3 (Rad60-<br>SLD) | MSEEKPKEGVKTENDHINLKVAGQDGSVVQFKIKRHTPLSKLMKAYCERQGLSM<br>RQIRFRFDGQPINETDTPAQLEMEDEDTIDVFQQQTGGVPESSLAGHSE |
| 560 | HERC2 (Cyt-b5) | MPSESFCLAAQARLDSKWLKTDIQLAFTRDGLCGLWNEMVKDGEIVYTGTESTQ<br>NGELPPRKDDSVEPSGTKKEDLNDKEKKDEEETPAPIYRAKSILDSWVWGKQPD<br>VNELKECLSVLVKEQQALAVQSATTTLSALRLKQRLVILERYFIALNRTVFQEN<br>VKVKWKSSGISLPPVDKKSSRPAGKGVEGLARVGSRAALSFAFAFLRRAWRSGE<br>DADLCSELLQESLDALRALPEASLEDESTVSSVWLEVVERATRELRSVVTGDVH<br>GTPATKGPGSIPLQDQHLALAILLELAVQRGTLSQMLSAILLLLQLWDSGAQET<br>DNERSAQGTSAPLLPLLQRFQSIICRKDAPHSEGDMHLLSGPLSPNESFLRYLT<br>LPQDNELAIDLRQTAVVVMAHLDRLATPCMPPLCSSPTSHKGSLQEVIGWGLIG<br>WKYYANVIGPIQCEGLANLGVTQIACAEKRFLILSRNGRVYTQAYNSDTLAPQL<br>VQGLASRNIVKIAAHSDGHHYLALAATGEVYSWGCGDGGRLGHGDTVPLEEPKV<br>ISAFSGKQAGKHVVHIACGSTYSAAITAEGELYTWGRGNYGRLGHGSSEDEAIP<br>MLVAGLKGLKVIDVACGSGDAQTLAVTENGQVWSWGDGDYGKLGRGGSDGCKTP<br>KLIEKLQDLDVVKVRCGSQFSIALTKDGQVYSWGKGDNQRLGHGTEEHVRYPKL<br>LEGLQGKKVIDVAAGSTHCALTEDSEVHSWGSNDQCQHFDTLRVTKPEPAALP<br>GLDTKHIVGIACGPAQSFAWSSCSEWSIGLRVPFVVDICSMTFEQLDLLLRQVS<br>EGMDGSADWPPPQEKECVAVATLNLLRLQLHAAISHQVDPEFLGLGLGSILLNS<br>LKQTVVTLASSAGVLSTVQSAAQAVLQSGWSVLLPTAEERARALSALLPCAVSG |

TABLE 18-continued

Sequence listing.

| SEQ | Description | Sequence |
|---|---|---|
| | | NEVNISPGRREMIDLLVGSLMADGGLESALHAAITAEIQDIEAKKEAQKEKEID
EQEANASTFHRSRTPLDKDLINTGICESSGKQCLPLVQLIQQLLRNIASQTVAR
LKDVARRISSCLDFEQHSRERSASLDLLLRFQRLLISKLYPGESIGQTSDISSP
ELMGVGSLLKKYTALLCTHIGDILPVAASIASTSWRHFAEVAYIVEGDFTGVLL
PELVVSIVLLLSKNAGLMQEAGAVPLLGGLLEHLDRENHLAPGKERDDHEELAW
PGIMESFFTGQNCRNNEEVTLIRKADLENHNKDGGFWTVIDGKVYDIKDFQTQS
LTGNSILAQFAGEDPVVALEAALQFEDTRESMHAFCVGQYLEPDQEIVTIPDLG
SLSSPLIDTERNLGLLLGLHASYLAMSTPLSPVEIECAKWLQSSIFSGGLQTSQ
IHYSYNEEKDEDHCSSPGGTPASKSRLCSHRRALGDHSQAFLQAIADNNIQDHN
VKDFLCQIERYCRQCHLTTPIMFPPEHPVEEVGRLLLCCLLKHEDLGHVALSLV
HAGALGIEQVKHRTLPKSVVDVCRVVYQAKCSLIKTHQEQGRSYKEVCAPVIER
LRFLFNELRPAVCNDLSIMSKEKLLSSLPRWRRIAQKIIRERRKKRVPKKPEST
DDEEKIGNEESDLEEACILPHSPINVDKRPIAIKSPKDKWQPLLSTVTGVHKYK
WLKQNVQGLYPQSPLLSTIAEFALKEEPVDVEKMRKCLLKQLERAEVRLEGIDT
ILKLASKNFLLPSVQYAMFCGWQRLIPEGIDIGEPLTDCLKDVDLIPPENRMLL
EVTFGKLYAWAVQNIRNVLMDASAKFKELGIQPVPLQTITNENPSGPSLGTIPQ
ARFLLVMLSMLTLQHGANNLDLLLNSGMLALTQTALRLIGPSCDNVEEDMNASA
QGASATVLEETRKETAPVQLPVSGPELAAMMKIGTRVMRGVDWKWGDQDGPPPG
LGRVIGELGEDGWIRVQWDTGSTNSYRMGKEGKYDLKLAELPAAAQPSAEDSDT
EDDSEAEQTERNIHPTAMMFTSTINLLQTLCLSAGVHAEIMQSEATKTLCGLLR
MLVESGTTDKTSSPNRLVYREQHRSWCTLGFVRSIALTPQVCGALSSPQWITLL
MKVVEGHAPFTATSLQRQILAVHLLQAVLPSWDKTERARDMKCLVEKLEDELGS
LLTTCSSDVPLLRESTLRRRRVRPQASLTATHSSTLAEEVVALLRTLHSLTQWN
GLINKYINSQLRSITHSFVGRPSEGAQLEDYFPDSENPEVGGLMAVLAVIGGID
GRLRLGGQVMHDEFGEGTVTRITPKGKITVQFSDMRTCRVCPLNQLKPLPAVAF
NVNNLPFTEPMLSVWAQLVNLAGSKLEKHKIKKSTKQAFAGQVDLDLLRCQQLK
LYILKAGRALLSHQDKLRQILSQPAVQETGTVHTDDGAVVSPDLGDMSPEGPQP
PMILLQQLLASATQPSPVKAIFDKQELEAAALAVCQCLAVESTHPSSPGFEDCS
SSEATTPVAVQHIRPARVKRRQSPVPALPIVVQLMEMGFSRRNIEFALKSLTG
ASGNASSLPGVEALVGWLLDHSDIQVTELSDADTVSDEYSDEEVVEDVDDAAYS
MSTGAVVTESQTYKKRADFLSNDDYAVYVRENIQVGMMVRCCRAYEEVCEGDVG
KVIKLDRDGLHDLNVQCDWQQKGGTYWVRYIHVELIGYPPPSSSSHIKIGDKVR
VKASVTTPKYKWGSVTHQSVGVVKAFSANGKDIIVDFPQQSHWTGLLSEMELVP
SIHPGVTCDGCQMFPINGSRFKCRNCDDEDFCETCFKTKKHNTRHTFGRINEPG
QSAVFCGRSGKQLKRCHSSQPGMLLDSWSRMVKSLNVSSSVNQASRLIDGSEPC
WQSSGSGQKHWIRLEIFPDVLVHRLKMIVDPADSSYMPSLVVVSGGNSLNNLIE
LKTININPSDTTVPLLNDCTEYHRYIEIAIKQCRSSGIDCKIHGLILLGRIRAE
EEDLAAVPFLASDNEEEEDEKGNSGSLIRKKAAGLESAATIRTKVFVWGLNDKD
QLGGLKGSKIKVPSFSETLSALNVVQVAGGSKSLFAVTVEGKVYACGEATNGRL
GLGISSGTVPIPRQITALSSYVVKKVAVHSGGRHATALTVDGKVFSWGEGDDGK
LGHFSRMNCDKPRLIEALKTKRIRDIACGSSHSAALTSSGELYTWGLGEYGRLG
HGDNTTQLKPKMVKVLLGHRVIQVACGSRDAQTLALTDEGLVESWGDGDFGKLG
RGGSEGCNIPQNIERLNGQGVCQIECGAQFSLALTKSGVVWTWGKGDYFRLGHG
SDVHVRKPQVVEGLRGKKIVHVAVGALHCLAVTDSGQVYAWGDNDHGQQGNGTT
TVNRKPTLVQGLEGQKITRVACGSSHSVAWTTVDVATPSVHEPVLFQTARDPLG
ASYLGVPSDADSSAASNKISGASNSKPNRPSLAKILLSLDGNLAKQQALSHILT
ALQIMYARDAVVGALMPAAMIAPVECPSESSAAPSDASAMASPMNGEECMLAVD
IEDRLSPNPWQEKREIVSSEDAVTPSAVTPSAPSASARPFIPVTDDLGAASIIA
ETMTKTKEDVESQNKAAGPEPQALDEFTSLLIADDTRVVVDLLKLSVCSRAGDR
GRDVLSAVLSGMGTAYPQVADMLLELCVTELEDVATDSQSGRLSSQPVVVESSH
PYTDDTSTSGTVKIPGAEGLRVEFDRQCSTERRHDPLTVMDGVNRIVSVRSGRE
WSDWSSELRIPGDELKWKFISDGSVNGWGWRFTVYPIMPAAGPKELLSDRCVLS
CPSMDLVTCLLDERLNLASNRSIVPRLAASLAACAQLSALAASHRMWALQRLRK
LLTTEFGQSININRLLGENDGETRALSFTGSALAALVKGLPEALQRQFEYEDPI
VRGGKQLLHSPFFKVLVALACDLELDTLPCCAETHKWAWERRYCMASRVAVALD
KRTPLPRLFLDEVAKKIRELMADSENMDVLHESHDIFKREQDEQLVQWMNRRPD
DWTLSAGGSGTIYGWGHNHRGQLGGIEGAKVKVPTPCEALATLRPVQLIGGEQT
LFAVTADGKLYATGYGAGGRLGIGGTESVSTPTLLESIQHVFIKKVAVNSGGKH
CLALSSEGEVYSWGEAEDGKLGHGNRSPCDRPRVIESLRGIEVVDVAAGGAHSA
CVTAAGDLYTWGKGRYGRLGHSDSEDQLKPKLVEALQGHRVVDIACGSGDAQTL
CLTDDDTVWSWGDGDYGKLGRGGSDGCKVPMKIDSLTGLGVVKVECGSQFSVAL
TKSGAVYTWGKGDYHRLGHGSDDHVRRPRQVQGLQGKKVIAIATGSLHCVCCTE
DGEVYTWGDNDEGQLGDGTTNAIQRPRLVAALQGKKVNRVACGSAHTLAWSTSK
PASAGKLPAQVPMEYNHLQEIPIIALRNRLLLLHHLSELFCPCIPMEDLEGSLD
ETGLGPSVGEDTLRGILISQGKEAAFRKVVQATMVRDRQHGPVVELNRIQVKRS
RSKGGLAGPDGTKSVFGQMCAKMSSFGPDSLLLPHRVWKVKFVGESVDDCGGGY
SESIAEICEELQNGLTPLLIVTPNGRDESGANRDCYLLSPAARAPVHSSMEREL
GVLLGIARTGSPLSLNLAEPVWKQLAGMSLTIADLSEVDKDFIPGLMYIRDNE
ATSEEFEAMSLPFTVPSASGQDIQLSSKHTHITLDNRAEYVRLAINYRLHEFDE
QVAAVREGMARVVPVPLLSLFTGYELETMVCGSPDIPLHLLKSVATYKGIEPSA
SLIQWFWEVMESESNTERSLFLRFVWGRTRLPRTIADERGRDFVIQVLDKYNPP
DHFLPESYTCFFLLKLPRYSCKQVLEEKLKYAIHFCKSIDTDDYARIALTGEPA
ADDSSDDSNEDVDSFASDSTQDYLTGH |

TABLE 18-continued

Sequence listing.

| SEQ | Description | Sequence |
|---|---|---|
| 561 | BIN1 (SH3_9) | MAEMGSKGVTAGKIASNVQKKLTRAQEKVLQKLGKADETKDEQFEQCVQNENKQ<br>LTEGTRLQKDLRTYLASVKAMHEASKKLNECLQEVYEPDWPGRDEANKIAENND<br>LLWMDYHQKLVDQALLTMDTYLGQFPDIKSRIAKRGRKLVDYDSARHHYESLQT<br>AKKKDEAKIAKPVSLLEKAAPQWCQGKLQAHLVAQTNLLRNQAEEELIKAQKVF<br>EEMNVDLQEELPSLWNSRVGFYVNTFQSIAGLEENFHKEMSKLNQNLNDVLVGL<br>EKQHGSNTFTVKAQPSDNAPAKGNKSPSPPDGSPAATPEIRVNHEPEPAGGATP<br>GATLPKSPSQLRKGPPVPPPPKHTPSKEVKQEQILSLFEDTFVPEISVTTPSQF<br>EAPGPFSEQASLLDLDEDPLPPVTSPVKAPTPSGQSIPWDLWEPTESPAGSLPS<br>GEPSAAEGTFAVSWPSQTAEPGPAQPAEASEVAGGTQPAAGAQEPGETAASEAA<br>SSSLPAVVVETFPATVNGTVEGGSGAGRLDLPPGEMFKVQAQHDYTATDTDELQ<br>LKAGDVVLVIPFQNPEEQDEGWLMGVKESDWNQHKELEKCRGVFPENFTERVP |
| 562 | PCGF2 (RING finger protein domain) | MHRTTRIKITELNPHLMCALCGGYFIDATTIVECLHSFCKTCIVRYLETNKYCP<br>MCDVQVHKTRPLLSIRSDKTLQDIVYKLVPGLFKDEMKRRRDFYAAYPLTEVPN<br>GSNEDRGEVLEQEKGALSDDEIVSLSIEFYEGARDRDEKKGPLENGDGDKEKTG<br>VRFLRCPAAMTVMHLAKFLRNKMDVPSKYKVEVLYEDEPLKEYYTLMDIAYIYP<br>WRRNGPLPLKYRVQPACKRLTLATVPTPSEGTNTSGASECESVSDKAPSPATLP<br>ATSSSLPSPATPSHGSPSSHGPPATHPTSPTPPSTASGATTAANGGSLNCLQTP<br>SSTSRGRKMTVNGAPVPPLT |
| 563 | TOX (HMG box) | MDVRFYPPPAQPAAAPDAPCLGPSPCLDPYYCNKEDGENMYMSMTEPSQDYVPA<br>SQSYPGPSLESEDFNIPPITPPSLPDHSLVHLNEVESGYHSLCHPMNHNGLLPF<br>HPQNMDLPEITVSNMLGQDGTLLSNSISVMPDIRNPEGTQYSSHPQMAAMRPRG<br>QPADIRQQPGMMPHGQLTTINQSQLSAQLGLNMGGSNVPHNSPSPPGSKSATPS<br>PSSSVHEDEGDDTSKINGGEKRPASDMGKKPKTPKKKKKKDPNEPQKPVSAYAL<br>FFRDTQAAIKGQNPNATFGEVSKIVASMWDGLGEEQKQVYKKKTEAAKKEYLKQ<br>LAAYRASLVSKSYSEPVDVKTSQPPQLINSKPSVFHGPSQAHSALYLSSHYHQQ<br>PGMNPHLTAMHPSLPRNIAPKPNNQMPVTVSIANMAVSPPPPLQISPPLHQHLN<br>MQQHQPLTMQQPLGNQLPMQVQSALHSPTMQQGFTLQPDYQTIINPTSTAAQVV<br>TQAMEYVRSGCRNPPPQPVDWNNDYCSSGGMQRDKALYLT |
| 564 | FOXA1 (HNF3A C-terminal domain) | MLGTVKMEGHETSDWNSYYADTQEAYSSVPVSNMNSGLGSMNSMNTYMTMNTMT<br>TSGNMTPASFNMSYANPGLGAGLSPGAVAGMPGGSAGAMNSMTAAGVTAMGTAL<br>SPSGMGAMGAQQAASMNGLGPYAAAMNPCMSPMAYAPSNLGRSRAGGGGDAKTF<br>KRSYPHAKPPYSYISLITMAIQQAPSKMLTLSEIYQWIMDLFPYYRQNQQRWQN<br>SIRHSLSFNDCFVKVARSPDKPGKGSYWTLHPDSGNMFENGCYLRRQKRFKCEK<br>QPGAGGGGGSGGGSGAKGGPESRKDPSGASNPSADSPLHRGVHGKTGQLEGAP<br>APGPAASPQTLDHSGATATGGASELKTPASSTAPPISSGPGALASVPASHPAHG<br>LAPHESQLHLKGDPHYSENHPESINNLMSSSEQQHKLDFKAYEQALQYSPYGST<br>LPASLPLGSASVTTRSPIEPSALEPAYYQGVYSRPVLNTS |
| 565 | FOXA2 (HNF3B C-terminal domain) | MLGAVKMEGHEPSDWSSYYAEPEGYSSVSNMNAGLGMNGMNTYMSMSAAAMGSG<br>SGNMSAGSMNMSSYVGAGMSPSLAGMSPGAGAMAGMGGSAGAAGVAGMGPHLSP<br>SLSPLGGQAAGAMGGLAPYANMNSMSPMYGQAGLSRARDPKTYRRSYTHAKPPY<br>SYISLITMAIQQSPNKMLTLSEIYQWIMDLEPEYRQNQQRWQNSIRHSLSENDC<br>FLKVPRSPDKPGKGSFWTLHPDSGNMFENGCYLRRQKRFKCEKQLALKEAAGAA<br>GSGKKAAAGAQASQAQLGEAAGPASETPAGTESPHSSASPCQEHKRGGLGELKG<br>TPAAALSPPEPAPSPGQQQQAAAHLLGPPHHPGLPPEAHLKPEHHYAFNHPFSI<br>NNLMSSEQQHHSHHHHQPHKMDLKAYEQVMHYPGYGSPMPGSLAMGPVTNKTG<br>LDASPLAADTSYYQGVYSRPIMNSS |
| 566 | IRF2BP1 (IRF-2BP1_2 N-terminal domain) | MASVQASRRQWCYLCDLPKMPWAMVWDESEAVCRGCVNFEGADRIELLIDAARQ<br>LKRSHVLPEGRSPGPPALKHPATKDLAAAAAQGPLPPPQAQPQPSGTGGGVSG<br>QDRYDRATSSGRLPLPSPALEYTLGSRLANGLGREEAVAEGARRALLGSMPGLM<br>PPGLLAAAVSGLGSRGLTLAPGLSPARPLFGSDFEKEKQQRNADCLAELNEAMR<br>GRAEEWHGRPKAVREQLLALSACAPFNVREKKDHGLVGRVFAFDATARPPGYEF<br>ELKLFTEYPCGSGNVYAGVLAVARQMFHDALREPGKALASSGFKYLEYERRHGS<br>GEWRQLGELLTDGVRSFREPAPAEALPQQYPEPAPAALCGPPPRAPSRNLAPTP<br>RRRKASPEPEGEAAGKMTTEEQQQRHWVAPGGPYSAETPGVPSPIAALKNVAEA<br>LGHSPKDPGGGGPVRAGGASPAASSTAQPPTQHRLVARINGEAEVSPTAGAEAV<br>SGGGSGTGATPGAPLCCTLCRERLEDTHFVQCPSVPGHKFCFPCSREFIKAQGP<br>AGEVYCPSGDKCPLVGSSVPWAFMQGEIATILAGDIKVKKERDP |
| 567 | IRF2BP2 (IRF-2BP1_2 N-terminal domain) | MAAAVAVAAASRRQSCYLCDLPRMPWAMIWDFTEPVCRGCVNYEGADRVEFVIE<br>TARQLKRAHGCFPEGRSPPGAAASAAAKPPPLSAKDILLQQQQQLGHGGPEAAP<br>RAPQALERYPLAAAAERPPRLGSDFGSSRPAASLAQPPTPQPPPVNGILVPNGE<br>SKLEEPPELNRQSPNPRRGHAVPPTLVPLMNGSATPLPTALGLGGRAAASLAAV<br>SGTAAASLGSAQPTDLGAHKRPASVSSSAAVEHEQREAAAKEKQPPPPAHRGPA<br>DSLSTAAGAAELSAEGAGKSRGSGEQDWVNRPKTVRDTLLALHQHGHSGPFESK<br>FKKEPALTAGRLLGFEANGANGSKAVARTARKRKPSPEPEGEVGPPKINGEAQP<br>WLSTSTEGLKIPMTPSSFVSPPPPTASPHSNRTTPPEAAQNGQSPMAALILVA<br>DNAGGSHASKDANQVHSTTRRNSNSPPSPSSMNQRRLGPREVGQGAGNTGGLE<br>PVHPASLPDSSLATSAPLCCTLCHERLEDTHEVQCPSVPSHKFCFPCSRQSIKQ<br>QGASGEVYCPSGEKCPLVGSNVPWAFMQGEIATILAGDVKVKKERDS |

TABLE 18-continued

Sequence listing.

| SEQ | Description | Sequence |
|---|---|---|
| 568 | IRF2BPL IRF-2BP1 2 N-terminal domain | MSAAQVSSSRRQSCYLCDLPRMPWAMIWDESEPVCRGCVNYEGADRIEFVIETA RQLKRAHGCFQDGRSPGPPPPVGVKTVALSAKEAAAAAAAAAAAAAAAQQQQQQ QQQQQQQQQQQQQQQQQQLNHVDGSSKPAVLAAPSGLERYGLSAAAAAAAAA AAVEQRSRFEYPPPPVSLGSSSHTARLPNGLGGPNGFPKPTPEEGPPELNRQSP NSSSAAASVASRRGTHGGLVTGLPNPGGGGGPQLTVPPNLLPQTLLNGPASAAV LPPPPPHALGSRGPPTPAPPGAPGGPACLGGTPGVSATSSSASSSTSSSVAEVG VGAGGKRPGSVSSTDQERELKEKQRNAEALAELSESLRNRAEEWASKPKMVRDT LLTLAGCTPYEVRFKKDHSLLGRVFAFDAVSKPGMDYELKLFIEYPTGSGNVYS SASGVAKQMYQDCMKDFGRGLSSGFKYLEYEKKHGSGDWRLLGDLLPEAVRFFK EGVPGADMLPQPYLDASCPMLPTALVSLSRAPSAPPGTGALPPAAPSGRGAAAS LRKRKASPEPPDSAEGALKLGEEQQRQQWMANQSEALKLTMSAGGFAAPGHAAG GPPPPPPPLGPHSNRTTPPESAPQNGPSPMAALMSVADTLGTAHSPKDGSSVHS TTASARRNSSSPVSPASVPGQRRLASRNGDLNLQVAPPPPSAHPGMDQVHPQNI PDSPMANSGPLCCTICHERLEDTHFVQCPSVPSHKFCFPCSRESIKAQGATGEV YCPSGEKCPLVGSNVPWAFMQGEIATILAGDVKVKKERDP |
| 569 | HOXA13 (homeodomain) | MTASVLLHPRWIEPTVMFLYDNGGGLVADELNKNMEGAAAAAAAAAAAAAAGAG GGGFPHPAAAAAGGNFSVAAAAAAAAAAAAANQCRNLMAHPAPLAPGAASAYSSA PGEAPPSAAAAAAAAAAAAAAAAASSSGGPGPAGPAGAEAAKQCSPCSAAAQS SSGPAALPYGYFGSGYYPCARMGPHPNAIKSCAQPASAAAAAAFADKYMDTAGP AAEEFSSRAKEFAFYHQGYAAGPYHHHQPMPGYLDMPVVPGLGGPGESRHEPLG LPMESYQPWALPNGWNGQMYCPKEQAQPPHLWKSTLPDVVSHPSDASSYRRGRK KRVPYTKVQLKELEREYATNKFITKDKRRRISATTNLSERQVTIWFQNRRVKEK KVINKLKTTS |
| 570 | HOXB13 (homeodomain) | MEPGNYATLDGAKDIEGLLGAGGGRNLVAHSPLTSHPAAPTLMPAVNYAPLDLP GSAEPPKQCHPCPGVPQGTSPAPVPYGYFGGGYYSCRVSRSSLKPCAQAATLAA YPAETPTAGEEYPSRPTEFAFYPGYPGTYQPMASYLDVSVVQTLGAPGEPRHDS LLPVDSYQSWALAGGWNSQMCCQGEQNPPGPEWKAAFADSSGQHPPDACAFRRG RKKRIPYSKGQLRELEREYAANKFITKDKRRKISAATSLSERQITIWFQNRRVK EKKVLAKVKNSATP |
| 571 | HOXC13 (homeodomain) | MTTSLLLHPRWPESLMYVYEDSAAESGIGGGGGGGGGGTGGAGGGCSGASPGKA PSMDGLGSSCPASHCRDLLPHPVLGRPPAPLGAPQGAVYTDIPAPEAARQCAPP PAPPTSSSATLGYGYPFGGSYYGCRLSHNVNLQQKPCAYHPGDKYPEPSGALPG DDLSSRAKEFAFYPSFASSYQAMPGYLDVSVVPGISGHPEPRHDALIPVEGYQH WALSNGWDSQVYCSKEQSQSAHLWKSPFFPDVVPLQPEVSSYRRGRKKRVPYTKV QLKELEKEYAASKFITKEKRRRISATTNLSERQVTIWFQNRRVKEKKVVSKSKA PHLHST |
| 572 | HOXA11 (homeodomain) | MDFDERGPCSSNMYLPSCTYYVSGPDFSSLPSFLPQTPSSRPMTYSYSSNLPQV QPVREVTFREYAIEPATKWHPRGNLAHCYSAEELVHRDCLQAPSAAGVPGDVLA KSSANVYHHPTPAVSSNFYSTVGRNGVLPQAFDQFFETAYGTPENLASSDYPGD KSAEKGPPAATATSAAAAAAATGAPATSSSDSGGGGGCRETAAAAEEKERRRP ESSSSPESSSGHTEDKAGGSSGQRTRKKRCPYTKYQIRELEREFFFSVYINKEK RLQLSRMLNLTDRQVKIWFQNRRMKEKKINRDRLQYYSANPLL |
| 573 | HOXC11 (homeodomain) | MENSVNLGNFCSPSRKERGADEGERGSCASNLYLPSCTYYMPEFSTVSSFLPQA PSRQISYPYSAQVPPVREVSYGLEPSGKWHHRNSYSSCYAAADELMHRECLPPS TVTEILMKNEGSYGGHHHPSAPHATPAGFYSSVNKNSVLPQAFDRFEDNAYCGG GDPPAEPPCSGKGEAKGEPEAPPASGLASRAEAGAEAEAEEENTNPSSSGSAHS VAKEPAKGAAPNAPRTRKKRCPYSKFQIRELEREFFENVYINKEKRLQLSRMLN LTDRQVKIWFQNRRMKEKKLSRDLQYFSGNPLL |
| 574 | HOXC10 (homeodomain) | MTCPRNVTPNSYAEPLAAPGGGERYSRSAGMYMQSGSDENCGVMRGCGLAPSLS KRDEGSSPSLALNTYPSYLSQLDSWGDPKAAYRLEQPVGRPLSSCSYPPSVKEE NVCCMYSAEKRAKSGPEAALYSHPLPESCLGEHEVPVPSYYRASPSYSALDKTP HCSGANDFEAPFEQRASLNPRAEHLESPQLGGKVSFPETPKSDSQTPSPNEIKT EQSLAGPKGSPSESEKERAKAADSSPDTSDNEAKEEIKAENTTGNWLTAKSGRK KRCPYTKHQTLELEKEFLENMYLTRERRLEISKTINLTDRQVKIWFQNRRMKLK KMNRENRIRELTSNENFT |
| 575 | HOXA10 (homeodomain) | MSARKGYLLPSPNYPTTMSCSESPAANSFLVDSLISSGRGEAGGGGGAGGGGG GGYYAHGGVYLPPAADLPYGLQSCGLFPTLGGKRNEAASPGSGGGGGLGPGAH GYGPSPIDLWLDAPRSCRMEPPDGPPPPPQQQPPPPPQPPQPAPQATSCSFAQN IKEESSYCLYDSADKCPKVSATAAELAPFFPRGPPPDGCALGTSSGVPVPGYERL SQAYGTAKGYGSGGGGAQQLGAGPFPAQPPGRGEDLPPALASGSADAARKERAL DSPPPPTLACGSGGGSQGDEEAHASSSAAEELSPAPSESSKASPEKDSLGNSKG ENAANWLTAKSGRKKRCPYTKHQTLELEKEFLENMYLTRERRLEISRSVHLTDR QVKIWFQNRRMKLKKMNRENRIRELTANENFS |
| 576 | HOXB9 (homeodomain) | MSISGTLSSYYVDSIISHESEDAPPAKFPSGQYASSRQPGHAEHLEFPSCSFQP KAPVEGASWAPLSPHASGSLPSVYHPYIQPQGVPPAESRYLRTWLEPAPRGEAA PGQGQAAVKAEPLLGAPGELLKQGTPEYSLETSAGREAVLSNQRPGYGDNKICE GSEDKERPDQTNPSANWLHARSSRKKRCPYTKYQTLELEKEFLENMYLTRDRRH EVARLLNLSERQVKIWFQNRRMKKKMNKEQGKE |

TABLE 18-continued

Sequence listing.

| SEQ | Description | Sequence |
|---|---|---|
| 577 | HOXA9 (homeodomain) | MATTGALGNYYVDSFLLGADAADELSVGRYAPGTLGQPPRQAATLAEHPDFSPC SFQSKATVEGASWNPVHAAGANAVPAAVYHHHHHHPYVHPQAPVAAAAPDGRYM RSWLEPTPGALSFAGLPSSRPYGIKPEPLSARRGDCPTLDTHTLSLTDYACGSP PVDREKQPSEGAFSENNAENESGGDKPPIDPNNPAANWLHARSTRKKRCPYTKH QTLELEKEFLENMYLTRDRRYEVARLLNLTERQVKIWFQNRRMKMKKINKDRAK DE |
| 578 | ZFP28_HUMAN | NKKLEAVGTGIEPKAMSQGLVTFGDVAVDFSQEEWEWLNPIQRNLYRKVMLENY RNLASLGLCVSKPDVISSLEQGKEPW |
| 579 | ZN334_HUMAN | KMKKFQIPVSFQDLTVNFTQEEWQQLDPAQRLLYRDVMLENYSNLVSVGYHVSK PDVIFKLEQGEEPWIVEEFSNQNYPD |
| 580 | ZN568_HUMAN | CSQESALSEEEEDTTRPLETVTFKDVAVDLTQEEWEQMKPAQRNLYRDVMLENY SNLVTVGCQVTKPDVIFKLEQEEEPW |
| 581 | ZN37A_HUMAN | ITSQGSVSFRDVTVGFTQEEWQHLDPAQRTLYRDVMLENYSHLVSVGYCIPKPE VILKLEKGEEPWILEEKFPSQSHLEL |
| 582 | ZN181_HUMAN | PQVTFNDVAIDFTHEEWGWLSSAQRDLYKDVMVQNYENLVSVAGLSVTKPYVIT LLEDGKEPWMMEKKLSKGMIPDWESR |
| 583 | ZN510_HUMAN | PLRFSTLFQEQQKMNISQASVSFKDVTIEFTQEEWQQMAPVQKNLYRDVMLENY SNLVSVGYCCFKPEVIFKLEQGEEPW |
| 584 | ZN862_HUMAN | QDPSAEGLSEEVPVVFEELPVVFEDVAVYFTREEWGMLDKRQKELYRDVMRMNY ELLASLGPAAAKPDLISKLERRAAPW |
| 585 | ZN140_HUMAN | SQGSVTFRDVAIDFSQEEWKWLQPAQRDLYRCVMLENYGHLVSLGLSISKPDVV SLLEQGKEPWLGKREVKRDLFSVSES |
| 586 | ZN208_HUMAN | GSLTFRDVAIEFSLEEWQCLDTAQQNLYRNVMLENYRNLVELGIAAFKPDLIIF LEEGKESWNMKRHEMVEESPVICSHF |
| 587 | ZN248_HUMAN | NKSQEQVSFKDVCVDFTQEEWYLLDPAQKILYRDVILENYSNLVSVGYCITKPE VIFKIEQGEEPWILEKGFPSQCHPER |
| 588 | ZN571_HUMAN | PHLLVTFRDVAIDESQEEWECLDPAQRDLYRDVMLENYSNLISLDLESSCVTKK LSPEKEIYEMESLQWENMGKRINHHL |
| 589 | ZN699_HUMAN | EEERKTAELQKNRIQDSVVFEDVAVDETQEEWALLDLAQRNLYRDVMLENFQNL ASLGYPLHTPHLISQWEQEEDLQTVK |
| 590 | ZN726_HUMAN | GLLTFRDVAIEFSLEEWQCLDTAQKNLYRNVMLENYRNLAFLGIAVSKPDLIIC LEKEKEPWNMKRDEMVDEPPGICPHF |
| 591 | ZIK1_HUMAN | RAPTQVTVSPETHMDLTKGCVTFEDIAIYFSQDEWGLLDEAQRLLYLEVMLENE ALVASLGCGHGTEDEETPSDQNVSVG |
| 592 | ZNF2_HUMAN | AAVSPTTRCQESVTFEDVAVVETDEEWSRLVPIQRDLYKEVMLENYNSIVSLGL PVPQPDVIFQLKRGDKPWMVDLHGSE |
| 593 | Z705F_HUMAN | HSLEKVTFEDVAIDFTQEEWDMMDTSKRKLYRDVMLENISHLVSLGYQISKSYI ILQLEQGKELWREGRVFLQDQNPDRE |
| 594 | ZNF14_HUMAN | DSVSFEDVAVNETLEEWALLDSSQKKLYEDVMQETFKNLVCLGKKWEDQDIEDD HRNQGKNRRCHMVERLCESRRGSKCG |
| 595 | ZN471_HUMAN | NVEVVKVMPQDLVTFKDVAIDESQEEWQWMNPAQKRLYRSMMLENYQSLVSLGL CISKPYVISLLEQGREPWEMTSEMTR |
| 596 | ZN624_HUMAN | TQPDEDLHLQAEETQLVKESVTFKDVAIDFTLEEWRLMDPTQRNLHKDVMLENY RNLVSLGLAVSKPDMISHLENGKGPW |
| 597 | ZNF84_HUMAN | TMLQESFSFDDLSVDFTQKEWQLLDPSQKNLYKDVMLENYSSLVSLGYEVMKPD VIFKLEQGEEPWVGDGEIPSSDSPEV |
| 598 | ZNF7_HUMAN | EVVTFGDVAVHFSREEWQCLDPGQRALYREVMLENHSSVAGLAGELVEKPELIS RLEQGEEPWVLDLQGAEGTEAPRTSK |
| 599 | ZN891_HUMAN | RNAEEERMIAVFLTTWLQEPMTEKDVAVEFTQEEWMMLDSAQRSLYRDVMLENY RNLTSVEYQLYRLTVISPLDQEEIRN |
| 600 | ZN337_HUMAN | GPQGARRQAFLAFGDVTVDFTQKEWRLLSPAQRALYREVTLENYSHLVSLGILH SKPELIRRLEQGEVPWGEERRRRPGP |

TABLE 18-continued

Sequence listing.

| SEQ | Description | Sequence |
|---|---|---|
| 601 | Z705G_HUMAN | HSLKKLTFEDVAIDFTQEEWAMMDTSKRKLYRDVMLENISHLVSLGYQISKSYI ILQLEQGKELWREGRVFLQDQNPNRE |
| 602 | ZN529_HUMAN | MPEVEFPDQFFTVLTMDHELVTLRDVVINESQEEWEYLDSAQRNLYWDVMMENY SNLLSLDLESRNETKHLSVGKDIIQN |
| 603 | ZN729_HUMAN | PGAPGSLEMGPLTFRDVTIEFSLEEWQCLDTVQQNLYRDVMLENYRNLVELGMA VFKPDLITCLKQGKEPWNMKRHEMVT |
| 604 | ZN419_HUMAN | RDPAQVPVAADLLTDHEEGYVTFEDVAVYFSQEEWRLLDDAQRLLYRNVMLENE TLLASLGLASSKTHEITQLESWEEPF |
| 605 | Z705A_HUMAN | HSLKKVTFEDVAIDETQEEWAMMDTSKRKLYRDVMLENISHLVSLGYQISKSYI ILQLEQGKELWREGREFLQDQNPDRE |
| 606 | ZNF45_HUMAN | TKSKEAVTFKDVAVVFSEEELQLLDLAQRKLYRDVMLENFRNVVSVGHQSTPDG LPQLEREEKLWMMKMATQRDNSSGAK |
| 607 | ZN302_HUMAN | SQVTFSDVAIDFSHEEWACLDSAQRDLYKDVMVQNYENLVSVGLSVTKPYVIML LEDGKEPWMMEKKLSKAYPFPLSHSV |
| 608 | ZN486_HUMAN | PGPLRSLEMESLQFRDVAVEFSLEEWHCLDTAQQNLYRDVMLENYRHLVELGII VSKPDLITCLEQGIKPLTMKRHEMIA |
| 609 | ZN621_HUMAN | LQTTWPQESVTFEDVAVYFTQNQWASLDPAQRALYGEVMLENYANVASLVAFPF PKPALISHLERGEAPWGPDPWDTEIL |
| 610 | ZN688_HUMAN | APLLAPRPGETRPGCRKPGTVSFADVAVYFSPEEWGCLRPAQRALYRDVMQETY GHLGALGFPGPKPALISWMEQESEAW |
| 611 | ZN33A_HUMAN | NKVEQKSQESVSFKDVTVGFTQEEWQHLDPSQRALYRDVMLENYSNLVSVGYCV HKPEVIFRLQQGEEPWKQEEEFPSQS |
| 612 | ZN554_HUMAN | CFSQEERMAAGYLPRWSQELVTFEDVSMDFSQEEWELLEPAQKNLYREVMLENY RNVVSLEALKNQCTDVGIKEGPLSPA |
| 613 | ZN878_HUMAN | DSVAFEDVAVNFTQEEWALLDPSQKNLYREVMQETLRNLTSIGKKWNNQYIEDE HQNPRRNLRRLIGERLSESKESHQHG |
| 614 | ZN772_HUMAN | MGPAQVPMNSEVIVDPIQGQVNFEDVEVYFSQEEWVLLDEAQRLLYRDVMLENE ALMASLGHTSFMSHIVASLVMGSEPW |
| 615 | ZN224_HUMAN | TTFKEAMTFKDVAVVFTEEELGLLDLAQRKLYRDVMLENFRNLLSVGHQAFHRD TFHFLREEKIWMMKTAIQREGNSGDK |
| 616 | ZN184_HUMAN | DSTLLQGGHNLLSSASFQEAVTFKDVIVDETQEEWKQLDPGQRDLERDVTLENY THLVSIGLQVSKPDVISQLEQGTEPW |
| 617 | ZN544_HUMAN | EARSMLVPPQASVCFEDVAMAFTQEEWEQLDLAQRTLYREVTLETWEHIVSLGL FLSKSDVISQLEQEEDLCRAEQEAPR |
| 618 | ZNF57_HUMAN | DSVVFEDVAVDFTLEEWALLDSAQRDLYRDVMLETERNLASVDDGTQFKANGSV SLQDMYGQEKSKEQTIPNETGNNSCA |
| 619 | ZN283_HUMAN | EESHGALISSCNSRTMTDGLVTERDVAIDESQEEWECLDPAQRDLYVDVMLENY SNLVSLDLESKTYETKKIFSENDIFE |
| 620 | ZN549_HUMAN | VITPQIPMVTEEFVKPSQGHVTFEDIAVYFSQEEWGLLDEAQRCLYHDVMLENE SLMASVGCLHGIEAEEAPSEQTLSAQ |
| 621 | ZN211_HUMAN | VQLRPQTRMATALRDPASGSVTFEDVAVYFSWEEWDLLDEAQKHLYFDVMLENE ALTSSLGCWCGVEHEETPSEQRISGE |
| 622 | ZN615_HUMAN | MQAQESLTLEDVAVDFTWEEWQFLSPAQKDLYRDVMLENYSNLVAVGYQASKPD ALSKLERGEETCTTEDEIYSRICSEI |
| 623 | ZN253_HUMAN | GPLQFRDVAIEFSLEEWHCLDTAQRNLYRDVMLENYRNLVFLGIVVSKPDLVTC LEQGKKPLTMERHEMIAKPPVMSSHF |
| 624 | ZN226_HUMAN | NMFKEAVTFKDVAVAFTEEELGLLGPAQRKLYRDVMVENFRNLLSVGHPPFKQD VSPIERNEQLWIMTTATRRQGNLGEK |
| 625 | ZN730_HUMAN | GALTERDVAIEFSLEEWQCLDTEQQNLYRNVMLDNYRNLVELGIAVSKPDLITC LEQEKEPWNLKTHDMVAKPPVICSHI |

TABLE 18-continued

Sequence listing.

| SEQ | Description | Sequence |
|---|---|---|
| 626 | Z585A_HUMAN | SPQKSSALAPEDHGSSYEGSVSFRDVAIDESREEWRHLDPSQRNLYRDVMLETY SHLLSVGYQVPEAEVVMLEQGKEPWA |
| 627 | ZN732_HUMAN | ELLTFRDVAIEFSPEEWKCLDPAQQNLYRDVMLENYRNLISLGVAISNPDLVIY LEQRKEPYKVKIHETVAKHPAVCSHE |
| 628 | ZN681_HUMAN | EPLKERDVAIEFSLEEWQCLDTIQQNLYRNVMLENYRNLVFLGIVVSKPDLITC LEQEKEPWTRKRHRMVAEPPVICSHE |
| 629 | ZN667_HUMAN | PSARGKSKSKAPITFGDLAIYFSQEEWEWLSPIQKDLYEDVMLENYRNLVSLGL SFRRPNVITLLEKGKAPWMVEPVRRR |
| 630 | ZN649_HUMAN | TKAQESLTLEDVAVDFTWEEWQFLSPAQKDLYRDVMLENYSNLVSVGYQAGKPD ALTKLEQGEPLWTLEDEIHSPAHPEI |
| 631 | ZN470_HUMAN | SQEEVEVAGIKLCKAMSLGSVTFTDVAIDESQDEWEWLNLAQRSLYKKVMLENY RNLVSVGLCISKPDVISLLEQEKDPW |
| 632 | ZN484_HUMAN | TKSLESVSFKDVTVDESRDEWQQLDLAQKSLYREVMLENYENLISVGCQVPKPE VIFSLEQEEPCMLDGEIPSQSRPDGD |
| 633 | ZN431_HUMAN | SGCPGAERNLLVYSYFEKETLTERDVAIEFSLEEWECLNPAQQNLYMNVMLENY KNLVELGVAVSKQDPVTCLEQEKEPW |
| 634 | ZN382_HUMAN | PLQGSVSFKDVTVDETQEEWQQLDPAQKALYRDVMLENYCHFVSVGFHMAKPDM IRKLEQGEELWTQRIFPSYSYLEEDG |
| 635 | ZN254_HUMAN | PGPPRSLEMGLLTFRDVAIEFSLEEWQHLDIAQQNLYRNVMLENYRNLAFLGIA VSKPDLITCLEQGKEPWNMKRHEMVD |
| 636 | ZN124_HUMAN | SGHPGSWEMNSVAFEDVAVNFTQEEWALLDPSQKNLYRDVMQETERNLASIGNK GEDQSIEDQYKNSSRNLRHIISHSGN |
| 637 | ZN607_HUMAN | SYGSITFGDVAIDESHQEWEYLSLVQKTLYQEVMMENYDNLVSLAGHSVSKPDL ITLLEQGKEPWMIVREETRGECTDLD |
| 638 | ZN317_HUMAN | DLFVCSGLEPHTPSVGSQESVTFQDVAVDFTEKEWPLLDSSQRKLYKDVMLENY SNLTSLGYQVGKPSLISHLEQEEEPR |
| 639 | ZN620_HUMAN | FQTAWRQEPVTFEDVAVYFTQNEWASLDSVQRALYREVMLENYANVASLAFPFT TPVLVSQLEQGELPWGLDPWEPMGRE |
| 640 | ZN141_HUMAN | ELLTFRDVAIEFSPEEWKCLDPDQQNLYRDVMLENYRNLVSLGVAISNPDLVTC LEQRKEPYNVKIHKIVARPPAMCSHF |
| 641 | ZN584_HUMAN | AGEAEAQLDPSLQGLVMFEDVTVYFSREEWGLLNVTQKGLYRDVMLENFALVSS LGLAPSRSPVFTQLEDDEQSWVPSWV |
| 642 | ZN540_HUMAN | AHALVTERDVAIDFSQKEWECLDTTQRKLYRDVMLENYNNLVSLGYSGSKPDVI TLLEQKEPCVVARDVTGRQCPGLLS |
| 643 | ZN75D_HUMAN | KRIKHWKMASKLILPESLSLLTFEDVAVYFSEEEWQLLNPLEKTLYNDVMQDIY ETVISLGLKLKNDTGNDHPISVSTSE |
| 644 | ZN555_HUMAN | DSVVFEDVAVDETLEEWALLDSAQRDLYRDVMLETFQNLASVDDETQFKASGSV SQQDIYGEKIPKESKIATFTRNVSWA |
| 645 | ZN658_HUMAN | NMSQASVSFQDVTVEFTREEWQHLGPVERTLYRDVMLENYSHLISVGYCITKPK VISKLEKGEEPWSLEDEFLNQRYPGY |
| 646 | ZN684_HUMAN | ISFQESVTFQDVAVDETAEEWQLLDCAERTLYWDVMLENYRNLISVGCPITKTK VILKVEQGQEPWMVEGANPHESSPES |
| 647 | RBAK_HUMAN | NTLQGPVSFKDVAVDETQEEWQQLDPDEKITYRDVMLENYSHLVSVGYDTTKPN VIIKLEQGEEPWIMGGEFPCQHSPEA |
| 648 | ZN829_HUMAN | HPEEEERMHDELLQAVSKGPVMFRDVSIDESQEEWECLDADQMNLYKEVMLENF SNLVSVGLSNSKPAVISLLEQGKEPW |
| 649 | ZN582_HUMAN | SLGSELERDVAIVESQEEWQWLAPAQRDLYRDVMLETYSNLVSLGLAVSKPDVI SFLEQGKEPWMVERVVSGGLCPVLES |
| 650 | ZN112_HUMAN | TKFQEMVTFKDVAVVFTEEELGLLDSVQRKLYRDVMLENERNLLLVAHQPFKPD LISQLEREEKLLMVETETPRDGCSGR |

TABLE 18-continued

Sequence listing.

| SEQ | Description | Sequence |
|---|---|---|
| 651 | ZN716_HUMAN | AKRPGPPGSREMGLLTFRDIAIEFSLAEWQCLDHAQQNLYRDVMLENYRNLVSL GIAVSKPDLITCLEQNKEPQNIKRNE |
| 652 | HKR1_HUMAN | TCMVHRQTMSCSGAGGITAFVAFRDVAVYFTQEEWRLLSPAQRTLHREVMLETY NHLVSLEIPSSKPKLIAQLERGEAPW |
| 653 | ZN350_HUMAN | IQAQESITLEDVAVDFTWEEWQLLGAAQKDLYRDVMLENYSNLVAVGYQASKPD ALFKLEQGEQLWTIEDGIHSGACSDI |
| 654 | ZN480_HUMAN | AQKRRKRKAKESGMALPQGHLTFRDVAIEFSQAEWKCLDPAQRALYKDVMLENY RNLVSLGISLPDLNINSMLEQRREPW |
| 655 | ZN416_HUMAN | DSTSVPVTAEAKLMGFTQGCVTFEDVAIYESQEEWGLLDEAQRLLYRDVMLENF ALITALVCWHGMEDEETPEQSVSVEG |
| 656 | ZNF92_HUMAN | GPLTFRDVKIEFSLEEWQCLDTAQRNLYRDVMLENYRNLVFLGIAVSKPDLITW LEQGKEPWNLKRHEMVDKTPVMCSHE |
| 657 | ZN100_HUMAN | SGCPGAERSLLVQSYFEKGPLTFRDVAIEFSLEEWQCLDSAQQGLYRKVMLENY RNLVFLAGIALTKPDLITCLEQGKEP |
| 658 | ZN736_HUMAN | GVLTFRDVAVEFSPEEWECLDSAQQRLYRDVMLENYGNLVSLGLAIFKPDLMTC LEQRKEPWKVKRQEAVAKHPAGSFHF |
| 659 | ZNF74_HUMAN | KENLEDISGWGLPEARSKESVSFKDVAVDETQEEWGQLDSPQRALYRDVMLENY QNLLALGPPLHKPDVISHLERGEEPW |
| 660 | CBX1_HUMAN | EESEKPRGFARGLEPERIIGATDSSGELMELMKWKNSDEADLVPAKEANVKCPQ VVISFYEERLTWHSYPSEDDDKKDDK |
| 661 | ZN443_HUMAN | ASVALEDVAVNFTREEWALLGPCQKNLYKDVMQETIRNLDCVVMKWKDQNIEDQ YRYPRKNLRCRMLERFVESKDGTQCG |
| 662 | ZN195_HUMAN | TLLTERDVAIEFSLEEWKCLDLAQQNLYRDVMLENYRNLESVGLTVCKPGLITC LEQRKEPWNVKRQEAADGHPEMGFHH |
| 663 | ZN530_HUMAN | AAALRAPTQQVEVAFEDVAIYFSQEEWELLDEMQRLLYRDVMLENFAVMASLGC WCGAVDEGTPSAESVSVEELSQGRTP |
| 664 | ZN782_HUMAN | NTFQASVSFQDVTVEFSQEEWQHMGPVERTLYRDVMLENYSHLVSVGYCFTKPE LIFTLEQGEDPWLLEKEKGELSRNSP |
| 665 | ZN791_HUMAN | DSVAFEDVSVSESQEEWALLAPSQKKLYRDVMQETFKNLASIGEKWEDPNVEDQ HKNQGRNLRSHTGERLCEGKEGSQCA |
| 666 | ZN331_HUMAN | AQGLVTFADVAIDFSQEEWACLNSAQRDLYWDVMLENYSNLVSLDLESAYENKS LPTEKNIHEIRASKRNSDRRSKSLGR |
| 667 | Z354C_HUMAN | AVDLLSAQEPVTFRDVAVFFSQDEWLHLDSAQRALYREVMLENYSSLVSLGIPF SMPKLIHQLQQGEDPCMVEREVPSDT |
| 668 | ZN157_HUMAN | SPQRFPALIPGEPGRSFEGSVSFEDVAVDETRQEWHRLDPAQRTMHKDVMLETY SNLASVGLCVAKPEMIFKLERGEELW |
| 669 | ZN727_HUMAN | RVLTFRDVAVEFSPEEWECLDSAQQRLYRDVMLENYGNLFSLGLAIFKPDLITY LEQRKEPWNARRQKTVAKHPAGSLHE |
| 670 | ZN550_HUMAN | AETKDAAQMLVTFKDVAVTFTREEWRQLDLAQRTLYREVMLETCGLLVSLGHRV PKPELVHLLEHGQELWIVKRGLSHAT |
| 671 | ZN793_HUMAN | IEYQIPVSFKDVVVGFTQEEWHRLSPAQRALYRDVMLETYSNLVSVGYEGTKPD VILRLEQEEAPWIGEAACPGCHCWED |
| 672 | ZN235_HUMAN | TKFQEAVTEKDVAVAFTEEELGLLDSAQRKLYRDVMLENERNLVSVGHQSFKPD MISQLEREEKLWMKELQTQRGKHSGD |
| 673 | ZNF8_HUMAN | DEGVAGVMSVGPPAARLQEPVTERDVAVDETQEEWGQLDPTQRILYRDVMLETF GHLLSIGPELPKPEVISQLEQGTELW |
| 674 | ZN724_HUMAN | GPLTEMDVAIEFSVEEWQCLDTAQQNLYRNVMLENYRNLVELGIAVSKPDLITC LEQGKEPWNMERHEMVAKPPGMCCYF |
| 675 | ZN573_HUMAN | HQVGLIRSYNSKTMTCFQELVTERDVAIDESRQEWEYLDPNQRDLYRDVMLENY RNLVSLGGHSISKPVVVDLLERGKEP |

TABLE 18-continued

Sequence listing.

| SEQ | Description | Sequence |
|-----|-------------|----------|
| 676 | ZN577_HUMAN | NATIVMSVRREQGSSSGEGSLSFEDVAVGFTREEWQFLDQSQKVLYKEVMLENY INLVSIGYRGTKPDSLFKLEQGEPPG |
| 677 | ZN789_HUMAN | FPPARGKELLSFEDVAMYFTREEWGHLNWGQKDLYRDVMLENYRNMVLLGFQFP KPEMICQLENWDEQWILDLPRTGNRK |
| 678 | ZN718_HUMAN | ELLTFKDVAIEFSPEEWKCLDTSQQNLYRDVMLENYRNLVSLGVSISNPDLVTS LEQRKEPYNLKIHETAARPPAVCSHE |
| 679 | ZN300_HUMAN | MKSQGLVSFKDVAVDFTQEEWQQLDPSQRTLYRDVMLENYSHLVSMGYPVSKPD VISKLEQGEEPWIIKGDISNWIYPDE |
| 680 | ZN383_HUMAN | AEGSVMFSDVSIDESQEEWDCLDPVQRDLYRDVMLENYGNLVSMGLYTPKPQVI SLLEQGKEPWMVGRELTRGLCSDLES |
| 681 | ZN429_HUMAN | GPLTFTDVAIEFSLEEWQCLDTAQQNLYRNVMLENYRNLVELGIAVSKPDLITC LEKEKEPCKMKRHEMVDEPPVVCSHF |
| 682 | ZN677_HUMAN | ALSQGLFTFKDVAIEFSQEEWECLDPAQRALYRDVMLENYRNLLSLDEDNIPPE DDISVGFTSKGLSPKENNKEELYHLV |
| 683 | ZN850_HUMAN | NMEGLVMFQDLSIDESQEEWECLDAAQKDLYRDVMMENYSSLVSLGLSIPKPDV ISLLEQGKEPWMVSRDVLGGWCRDSE |
| 684 | ZN454_HUMAN | AVSHLPTMVQESVTFKDVAILFTQEEWGQLSPAQRALYRDVMLENYSNLVSLGL LGPKPDTFSQLEKREVWMPEDTPGGF |
| 685 | ZN257_HUMAN | GPLTIRDVTVEFSLEEWHCLDTAQQNLYRDVMLENYRNLVFLGIAVSKPDLITC LEQGKEPCNMKRHEMVAKPPVMCSHI |
| 686 | ZN264_HUMAN | AAAVLTDRAQVSVTFDDVAVTFTKEEWGQLDLAQRTLYQEVMLENCGLLVSLGC PVPKAELICHLEHGQEPWTRKEDLSQ |
| 687 | ZFP82_HUMAN | ALRSVMESDVSIDESPEEWEYLDLEQKDLYRDVMLENYSNLVSLGCFISKPDVI SSLEQGKEPWKVVRKGRRQYPDLETK |
| 688 | ZFP14_HUMAN | AHGSVTFRDVAIDFSQEEWEFLDPAQRDLYRDVMWENYSNFISLGPSISKPDVI TLLDEERKEPGMVVREGTRRYCPDLE |
| 689 | ZN485_HUMAN | APRAQIQGPLTFGDVAVAFTRIEWRHLDAAQRALYRDVMLENYGNLVSVGLLSS KPKLITQLEQGAEPWTEVREAPSGTH |
| 690 | ZN737_HUMAN | GPLQFRDVAIEFSLEEWHCLDTAQRNLYRNVMLENYRNLVFLGIVVSKPDLITC LEQGKKPLTMKKHEMVANPSVTCSHE |
| 691 | ZNF44_HUMAN | TLPRGQPEVLEWGLPKDQDSVAFEDVAVNFTHEEWALLGPSQKNLYRDVMRETI RNLNCIGMKWENQNIDDQHQNLRRNP |
| 692 | ZN596_HUMAN | PSPDSMTFEDIIVDFTQEEWALLDTSQRKLFQDVMLENISHLVSIGKQLCKSVV LSQLEQVEKLSTQRISLLQGREVGIK |
| 693 | ZN565_HUMAN | EESREIRAGQIVLKAMAQGLVTERDVAIEFSLEEWKCLEPAQRDLYREVTLENF GHLASLGLSISKPDVVSLLEQGKEPW |
| 694 | ZN543_HUMAN | AASAQVSVTFEDVAVTFTQEEWGQLDAAQRTLYQEVMLETCGLLMSLGCPLFKP ELIYQLDHRQELWMATKDLSQSSYPG |
| 695 | ZFP69_HUMAN | RESLEDEVTPGLPTAESQELLTFKDISIDFTQEEWGQLAPAHQNLYREVMLENY SNLVSVGYQLSKPSVISQLEKGEEPW |
| 696 | SUMO1_HUMAN | EGEYIKLKVIGQDSSEIHFKVKMTTHLKKLKESYCQRQGVPMNSLRELFEGQRI ADNHTPKELGMEEEDVIEVYQEQTGG |
| 697 | ZNF12_HUMAN | NKSLGPVSFKDVAVDFTQEEWQQLDPEQKITYRDVMLENYSNLVSVGYHIIKPD VISKLEQGEEPWIVEGEFLLQSYPDE |
| 698 | ZN169_HUMAN | SPGLLTTRKEALMAFRDVAVAFTQKEWKLLSSAQRTLYREVMLENYSHLVSLGI AFSKPKLIEQLEQGDEPWREENEHLL |
| 699 | ZN433_HUMAN | MFQDSVAFEDVAVTFTQEEWALLDPSQKNLCRDVMQETERNLASIGKKWKPQNI YVEYENLRRNLRIVGERLFESKEGHQ |
| 700 | SUMO3_HUMAN | ENDHINLKVAGQDGSVVQFKIKRHTPLSKLMKAYCERQGLSMRQIRFREDGQPI NETDTPAQLEMEDEDTIDVEQQQTGG |

TABLE 18-continued

Sequence listing.

| SEQ | Description | Sequence |
|---|---|---|
| 701 | ZNF98_HUMAN | PGPLGSLEMGVLTFRDVALEFSLEEWQCLDTAQQNLYRNVMLENYRNLVFVGIA<br>ASKPDLITCLEQGKEPWNVKRHEMVT |
| 702 | ZN175_HUMAN | LSQKPQVLGPEKQDGSCEASVSFEDVTVDESREEWQQLDPAQRCLYRDVMLELY<br>SHLFAVGYHIPNPEVIERMLKEKEPR |
| 703 | ZN347_HUMAN | ALTQGQVTFRDVAIEFSQEEWTCLDPAQRTLYRDVMLENYRNLASLGISCEDLS<br>IISMLEQGKEPFTLESQVQIAGNPDG |
| 704 | ZNF25_HUMAN | NKFQGPVTLKDVIVEFTKEEWKLLTPAQRTLYKDVMLENYSHLVSVGYHVNKPN<br>AVFKLKQGKEPWILEVEFPHRGFPED |
| 705 | ZN519_HUMAN | ELLTFRDVAIEFSPEEWKCLDPAQQNLYRDVMLENYRNLVSLAVYSYYNQGILP<br>EQGIQDSFKKATLGRYGSCGLENICL |
| 706 | Z585B_HUMAN | SPQKSSALAPEDHGSSYEGSVSERDVAIDESREEWRHLDLSQRNLYRDVMLETY<br>SHLLSVGYQVPKPEVVMLEQGKEPWA |
| 707 | ZIM3_HUMAN | NNSQGRVTFEDVTVNFTQGEWQRLNPEQRNLYRDVMLENYSNLVSVGQGETTKP<br>DVILRLEQGKEPWLEEEEVLGSGRAE |
| 708 | ZN517_HUMAN | AMALPMPGPQEAVVFEDVAVYFTRIEWSCLAPDQQALYRDVMLENYGNLASLGE<br>LVAKPALISLLEQGEEPGALILQVAE |
| 709 | ZN846_HUMAN | DSSQHLVTFEDVAVDFTQEEWTLLDQAQRDLYRDVMLENYKNLIILAGSELFKR<br>SLMSGLEQMEELRTGVTGVLQELDLQ |
| 710 | ZN230_HUMAN | TTFKEAVTEKDVAVFFTEEELGLLDPAQRKLYQDVMLENFTNLLSVGHQPFHPF<br>HFLREEKFWMMETATQREGNSGGKTI |
| 711 | ZNF66_HUMAN | GPLQFRDVAIEFSLEEWHCLDMAQRNLYRDVMLENYRNLVELGIVVSKPDLITH<br>LEQGKKPSTMQRHEMVANPSVLCSHE |
| 712 | ZFP1_HUMAN | NKSQGSVSFTDVTVDFTQEEWEQLDPSQRILYMDVMLENYSNLLSVEVWKADDQ<br>MERDHRNPDEQARQFLILKNQTPIEE |
| 713 | ZN713_HUMAN | EEEEMNDGSQMVRSQESLTFQDVAVDETREEWDQLYPAQKNLYRDVMLENYRNL<br>VALGYQLCKPEVIAQLELEEEWVIER |
| 714 | ZN816_HUMAN | EEATKKSKEKEPGMALPQGRLTERDVAIEFSLEEWKCLNPAQRALYRAVMLENY<br>RNLEFVDSSLKSMMEFSSTRHSITGE |
| 715 | ZN426_HUMAN | EKTPAGRIVADCLTDCYQDSVTFDDVAVDETQEEWTLLDSTQRSLYSDVMLENY<br>KNLATVGGQIIKPSLISWLEQEESRT |
| 716 | ZN674_HUMAN | AMSQESLTFKDVFVDFTLEEWQQLDSAQKNLYRDVMLENYSHLVSVGHLVGKPD<br>VIFRLGPGDESWMADGGTPVRTCAGE |
| 717 | ZN627_HUMAN | DSVAFEDVAVNFTLEEWALLDPSQKNLYRDVMRETFRNLASVGKQWEDQNIEDP<br>FKIPRRNISHIPERLCESKEGGQGEE |
| 718 | ZNF20_HUMAN | MFQDSVAFEDVAVSFTQEEWALLDPSQKNLYRDVMQETFKNLTSVGKTWKVQNI<br>EDEYKNPRRNLSLMREKLCESKESHH |
| 719 | Z587B_HUMAN | AVVATLRLSAQGTVTFEDVAVKFTQEEWNLLSEAQRCLYRDVTLENLALMSSLG<br>CWCGVEDEAAPSKQSIYIQRETQVRT |
| 720 | ZN316_HUMAN | EEEEEDEDEDDLLTAGCQELVTFEDVAVYFSLEEWERLEADQRGLYQEVMQENY<br>GILVSLGYPIPKPDLIFRLEQGEEPW |
| 721 | ZN233_HUMAN | TKFQEMVTFKDVAVVFTREELGLLDLAQRKLYQDVMLENFRNLLSVGYQPFKLD<br>VILQLGKEDKLRMMETEIQGDGCSGH |
| 722 | ZN611_HUMAN | EEAAQKRKGKEPGMALPQGRLTERDVAIEFSLAEWKCLNPSQRALYREVMLENY<br>RNLEAVDISSKCMMKEVLSTGQGNTE |
| 723 | ZN556_HUMAN | DTVVFEDVVVDFTLEEWALLNPAQRKLYRDVMLETFKHLASVDNEAQLKASGSI<br>SQQDTSGEKLSLKQKIEKFTRKNIWA |
| 724 | ZN234_HUMAN | TTFKEGLTFKDVAVVFTEEELGLLDPVQRNLYQDVMLENFRNLLSVGHHPFKHD<br>VFLLEKEKKLDIMKTATQRKGKSADK |
| 725 | ZN560_HUMAN | SALQQEFWKIQTSNGIQMDLVTFDSVAVEFTQEEWTLLDPAQRNLYSDVMLENY<br>KNLSSVGYQLFKPSLISWLEEEEELS |

TABLE 18-continued

Sequence listing.

| SEQ | Description | Sequence |
|---|---|---|
| 726 | ZNF77_HUMAN | DCVIFEEVAVNETPEEWALLDHAQRSLYRDVMLETCRNLASLDCYIYVRTSGSS SQRDVFGNGISNDEEIVKFTGSDSWS |
| 727 | ZN682_HUMAN | ELLTFRDVTIEFSLEEWEFLNPAQQSLYRKVMLENYRNLVSLGLTVSKPELISR LEQRQEPWNVKRHETIAKPPAMSSHY |
| 728 | ZN614_HUMAN | IKTQESLTLEDVAVEFSWEEWQLLDTAQKNLYRDVMVENYNHLVSLGYQTSKPD VLSKLAHGQEPWTTDAKIQNKNCPGI |
| 729 | ZN785_HUMAN | PAHVPGEAGPRRTRESRPGAVSFADVAVYFSPEEWECLRPAQRALYRDVMRETE GHLGALGFSVPKPAFISWVEGEVEAW |
| 730 | ZN445_HUMAN | GCPGDQVTPTRSLTAQLQETMTFKDVEVTFSQDEWGWLDSAQRNLYRDVMLENY RNMASLVGPFTKPALISWLEAREPWG |
| 731 | ZFP30_HUMAN | ARDLVMERDVAVDESQEEWECLNSYQRNLYRDVILENYSNLVSLAGCSISKPDV ITLLEQGKEPWMVVRDEKRRWTLDLE |
| 732 | ZN225_HUMAN | TTLKEAVTEKDVAVVFTEEELRLLDLAQRKLYREVMLENFRNLLSVGHQSLHRD TFHFLKEEKFWMMETATQREGNLGGK |
| 733 | ZN551_HUMAN | SPPSPRSSMAAVALRDSAQGMTFEDVAIYFSQEEWELLDESQRFLYCDVMLENE AHVTSLGYCHGMENEAIASEQSVSIQ |
| 734 | ZN610_HUMAN | DEEAQKRKAKESGMALPQGRLTEMDVAIEFSQEEWKSLDPGQRALYRDVMLENY RNLVFLGICLPDLSIISMLKQRREPL |
| 735 | ZN528_HUMAN | ALTQGPLKFMDVAIEFSQEEWKCLDPAQRTLYRDVMLENYRNLVSLGICLPDLS VTSMLEQKRDPWTLQSEEKIANDPDG |
| 736 | ZN284_HUMAN | TMFKEAVTFKDVAVVFTEEELGLLDVSQRKLYRDVMLENFRNLLSVGHQLSHRD TFHFQREEKFWIMETATQREGNSGGK |
| 737 | ZN418_HUMAN | QGTVAFEDVAVNFSQEEWSLLSEVQRCLYHDVMLENWVLISSLGCWCGSEDEEA PSKKSISIQRVSQVSTPGAGVSPKKA |
| 738 | MPP8_HUMAN | AEAFGDSEEDGEDVEEVEKILDMKTEGGKVLYKVRWKGYTSDDDTWEPEIHLED CKEVLLEFRKKIAENKAKAVRKDIQR |
| 739 | ZN490_HUMAN | VLQMQNSEHHGQSIKTQTDSISLEDVAVNFTLEEWALLDPGQRNIYRDVMRATE KNLACIGEKWKDQDIEDEHKNQGRNL |
| 740 | ZN805_HUMAN | AMALTDPAQVSVTEDDVAVTFTQEEWGQLDLAQRTLYQEVMLENCGLLVSLGCP VPRPELIYHLEHGQEPWTRKEDLSQG |
| 741 | Z780B_HUMAN | VHGSVTFRDVAIDESQEEWECLQPDQRTLYRDVMLENYSHLISLGSSISKPDVI TLLEQEKEPWIVVSKETSRWYPDLES |
| 742 | ZN763_HUMAN | DPVACEDVAVNETQEEWALLDISQRKLYREVMLETERNLTSIGKKWKDQNIEYE YQNPRRNFRSLIEGNVNEIKEDSHCG |
| 743 | ZN285_HUMAN | IKFQERVTFKDVAVVFTKEELALLDKAQINLYQDVMLENFRNLMLVRDGIKNNI LNLQAKGLSYLSQEVLHCWQIWKQRI |
| 744 | ZNF85_HUMAN | GPLTFRDVAIEFSLKEWQCLDTAQRNLYRNVMLENYRNLVELGITVSKPDLITC LEQGKEAWSMKRHEIMVAKPTVMCSH |
| 745 | ZN223_HUMAN | TMSKEAVTFKDVAVVFTEEELGLLDLAQRKLYRDVMLENFRNLLSVGHQPFHRD TFHFLREEKFWMMDIATQREGNSGGK |
| 746 | ZNF90_HUMAN | GPLEFRDVAIEFSLEEWHCLDTAQQNLYRDVMLENYRHLVELGIVVTKPDLITC LEQGKKPFTVKRHEMIAKSPVMCFHF |
| 747 | ZN557_HUMAN | GHTEGGELVNELLKSWLKGLVTFEDVAVEFTQEEWALLDPAQRTLYRDVMLENC RNLASLGNQVDKPRLISQLEQEDKVM |
| 748 | ZN425_HUMAN | AEPASVTVTEDDVALYFSEQEWEILEKWQKQMYKQEMKTNYETLDSLGYAFSKP DLITWMEQGRMLLISEQGCLDKTRRT |
| 749 | ZN229_HUMAN | HSQASAISQDREEKIMSQEPLSFKDVAVVFTEEELELLDSTQRQLYQDVMQENE RNLSVGERNPLGDKNGKDTEYIQDE |
| 750 | ZN606_HUMAN | GSLEEGRRATGLPAAQVQEPVTFKDVAVDFTQEEWGQLDLVQRTLYRDVMLETY GHLLSVGNQIAKPEVISLLEQGEEPW |

TABLE 18-continued

Sequence listing.

| SEQ | Description | Sequence |
|---|---|---|
| 751 | ZN155_HUMAN | TTFKEAVTFKDVAVVFTEEELGLLDPAQRKLYRDVMLENFRNLLSVGHQPFHQD TCHFLREEKFWMMGTATQREGNSGGK |
| 752 | ZN222_HUMAN | AKLYEAVTFKDVAVIFTEEELGLLDPAQRKLYRDVMLENERNLLSVGGKIQTEM ETVPEAGTHEEFSCKQIWEQIASDLT |
| 753 | ZN442_HUMAN | RSDLFLPDSQTNEERKQYDSVAFEDVAVNFTQEEWALLGPSQKSLYRDVMWETI RNLDCIGMKWEDTNIEDQHRNPRRSL |
| 754 | ZNF91_HUMAN | PGTPGSLEMGLLTFRDVAIEFSPEEWQCLDTAQQNLYRNVMLENYRNLAFLGIA LSKPDLITYLEQGKEPWNMKQHEMVD |
| 755 | ZN135_HUMAN | TPGVRVSTDPEQVTFEDVVVGESQEEWGQLKPAQRTLYRDVMLDTFRLLVSVGH WLPKPNVISLLEQEAELWAVESRLPQ |
| 756 | ZN778_HUMAN | EQTQAAGMVAGWLINCYQDAVTEDDVAVDETQEEWTLLDPSQRDLYRDVMLENY ENLASVEWRLKTKGPALRQDRSWFRA |
| 757 | RYBP_HUMAN | PSEANSIQSANATTKTSETNHTSRPRLKNVDRSTAQQLAVTVGNVTVIITDEKE KTRSSSTSSSTVTSSAGSEQQNQSSS |
| 758 | ZN534_HUMAN | ALTQGQLSESDVAIEFSQEEWKCLDPGQKALYRDVMLENYRNLVSLGEDNVRPE ACICSGICLPDLSVTSMLEQKRDPWT |
| 759 | ZN586_HUMAN | AAAAALRAPAQSSVTFEDVAVNESLEEWSLLNEAQRCLYRDVMLETLTLISSLG CWHGGEDEAAPSKQSTCIHIYKDQGG |
| 760 | ZN567_HUMAN | AQGSVSFNDVTVDFTQEEWQHLDHAQKTLYMDVMLENYCHLISVGCHMTKPDVI LKLERGEEPWTSFAGHTCLEENWKAE |
| 761 | ZN440_HUMAN | DPVAFKDVAVNFTQEEWALLDISQRKLYREVMLETERNLTSLGKRWKDQNIEYE HQNPRRNERSLIEEKVNEIKDDSHCG |
| 762 | ZN583_HUMAN | SKDLVTFGDVAVNESQEEWEWLNPAQRNLYRKVMLENYRSLVSLGVSVSKPDVI SLLEEQGKEPWMVKKEGTRGPCPDWEY |
| 763 | ZN441_HUMAN | DSVAFEDVAINFTCEEWALLGPSQKSLYRDVMQETIRNLDCIGMIWQNHDIEED QYKDLRRNLRCHMVERACEIKDNSQC |
| 764 | ZNF43_HUMAN | GPLTEMDVAIEFCLEEWQCLDIAQQNLYRNVMLENYRNLVELGIAVSKPDLITC LEQEKEPWEPMRRHEMVAKPPVMCSH |
| 765 | CBX5_HUMAN | QSNDIARGFERGLEPEKIIGATDSCGDLMFLMKWKDTDEADLVLAKEANVKCPQ IVIAFYEERLTWHAYPEDAENKEKET |
| 766 | ZN589_HUMAN | ALPAKDSAWPWEEKPRYLGPVTFEDVAVLFTEAEWKRLSLEQRNLYKEVMLENL RNLVSLAESKPEVHTCPSCPLAFGSQ |
| 767 | ZNF10_HUMAN | DAKSLTAWSRTLVTFKDVFVDFTREEWKLLDTAQQIVYRNVMLENYKNLVSLGY QLTKPDVILRLEKGEEPWLVEREIHQ |
| 768 | ZN563_HUMAN | DAVAFEDVAVNETQEEWALLGPSQKNLYRYVMQETIRNLDCIRMIWEEQNTEDQ YKNPRRNLRCHMVERFSESKDSSQCG |
| 769 | ZN561_HUMAN | EKTKVERMVEDYLASGYQDSVTFDDVAVDETPEEWALLDTTEKYLYRDVMLENY MNLASVEWEIQPRTKRSSLQQGFLKN |
| 770 | ZN136_HUMAN | DSVAFEDVDVNFTQEEWALLDPSQKNLYRDVMWETMRNLASIGKKWKDQNIKDH YKHRGRNLRSHMLERLYQTKDGSQRG |
| 771 | ZN630_HUMAN | IESQEPVTFEDVAVDETQEEWQQLNPAQKTLHRDVMLETYNHLVSVGCSGIKPD VIFKLEHGKDPWIIESELSRWIYPDR |
| 772 | ZN527_HUMAN | AVGLCKAMSQGLVTERDVALDESQEEWEWLKPSQKDLYRDVMLENYRNLVWLGL SISKPNMISLLEQGKEPWMVERKMSQ |
| 773 | ZN333_HUMAN | DKVEEEAMAPGLPTACSQEPVTFADVAVVETPEEWVELDSTQRSLYRDVMLENY RNLASVADQLCKPNALSYLEERGEQW |
| 774 | Z324B_HUMAN | TFEDVAVYFSQEEWGLLDTAQRALYRHVMLENFTLVTSLGLSTSRPRVVIQLER GEEPWVPSGKDMTLARNTYGRLNSGS |
| 775 | ZN786_HUMAN | AEPPRLPLTFEDVAIYFSEQEWQDLEAWQKELYKHVMRSNYETLVSLDDGLPKP ELISWIEHGGEPERKWRESQKSGNII |

TABLE 18-continued

Sequence listing.

| SEQ | Description | Sequence |
|---|---|---|
| 776 | ZN709_HUMAN | DSVVFEDVAVNETQEEWALLGPSQKKLYRDVMQETFVNLASIGENWEEKNIEDH KNQGRKLRSHMVERLCERKEGSQFGE |
| 777 | ZN792_HUMAN | AAAALRDPAQGCVTFEDVTIYFSQEEWVLLDEAQRLLYCDVMLENFALIASLGL ISFRSHIVSQLEMGKEPWVPDSVDMT |
| 778 | ZN599_HUMAN | AAPALALVSFEDVVVTFTGEEWGHLDLAQRTLYQEVMLETCRLLVSLGHPVPKP ELIYLLEHGQELWTVKRGLSQSTCAG |
| 779 | ZN613_HUMAN | IKSQESLTLEDVAVEFTWEEWQLLGPAQKDLYRDVMLENYSNLVSVGYQASKPD ALFKLEQGEPWTVENEIHSQICPEIK |
| 780 | ZF69B_HUMAN | GESLESRVTLGSLTAESQELLTFKDVSVDFTQEEWGQLAPAHRNLYREVMLENY GNLVSVGCQLSKPGVISQLEKGEEPW |
| 781 | ZN799_HUMAN | ASVALEDVAVNFTREEWALLGPCQKNLYKDVMQETIRNLDCVGMKWKDQNIEDQ YRYPRKNLRCRMLERFVESKDGTQCG |
| 782 | ZN569_HUMAN | TESQGTVTFKDVAIDFTQEEWKRLDPAQRKLYRNVMLENYNNLITVGYPFTKPD VIFKLEQEEEPWVMEEEVLRRHWQGE |
| 783 | ZN564_HUMAN | DSVASEDVAVNETLEEWALLDPSQKKLYRDVMRETFRNLACVGKKWEDQSIEDW YKNQGRILRNHMEEGLSESKEYDQCG |
| 784 | ZN546_HUMAN | EETQGELTSSCGSKTMANVSLAFRDVSIDLSQEEWECLDAVQRDLYKDVMLENY SNLVSLGYTIPKPDVITLLEQEKEPW |
| 785 | ZFP92_HUMAN | AAILLTTRPKVPVSFEDVSVYFTKTEWKLLDLRQKVLYKRVMLENYSHLVSLGF SFSKPHLISQLERGEGPWVADIPRTW |
| 786 | YAF2_HUMAN | KDKVEKEKSEKETTSKKNSHKKTRPRLKNVDRSSAQHLEVTVGDLTVIITDEKE KTKSPPASSAASADQHSQSGSSSDNT |
| 787 | ZN723_HUMAN | GPLTFTDVAIKESLEEWQFLDTAQQNLYRDVMLENYRNLVFLGVGVSKPDLITC LEQGKEPWNMKRHKMVAKPPVVCSHE |
| 788 | ZNF34_HUMAN | RKPNPQAMAALFLSAPPQAEVTFEDVAVYLSREEWGRLGPAQRGLYRDVMLETY GNLVSLGVGPAGPKPGVISQLERGDE |
| 789 | ZN439_HUMAN | LSLSPILLYTCEMFQDPVAFKDVAVNETQEEWALLDISQKNLYREVMLETFWNL TSIGKKWKDQNIEYEYQNPRRNERSV |
| 790 | ZFP57_HUMAN | AAGEPRSLLFFQKPVTFEDVAVNFTQEEWDCLDASQRVLYQDVMSETEKNLTSV ARIFLHKPELITKLEQEEEQWRETRV |
| 791 | ZNF19_HUMAN | AAMPLKAQYQEMVTFEDVAVHFTKTEWTGLSPAQRALYRSVMLENEGNLTALGY PVPKPALISLLERGDMAWGLEAQDDP |
| 792 | ZN404_HUMAN | ARVPLTESDVAIDESQEEWEYLNSDQRDLYRDVMLENYTNLVSLDENFTTESNK LSSEKRNYEVNAYHQETWKRNKTENL |
| 793 | ZN274_HUMAN | ASRLPTAWSCEPVTFEDVTLGFTPEEWGLLDLKQKSLYREVMLENYRNLVSVEH QLSKPDVVSQLEEAEDFWPVERGIPQ |
| 794 | CBX3_HUMAN | SKKKRDAADKPRGFARGLDPERIIGATDSSGELMFLMKWKDSDEADLVLAKEAN MKCPQIVIAFYEERLTWHSCPEDEAQ |
| 795 | ZNF30_HUMAN | AHKYVGLQYHGSVTFEDVAIAFSQQEWESLDSSQRGLYRDVMLENYRNLVSMGH SRSKPHVIALLEQWKEPEVTVRKDGR |
| 796 | ZN250_HUMAN | AAARLLPVPAGPQPLSFQAKLTFEDVAVLLSQDEWDRLCPAQRGLYRNVMMETY GNVVSLGLPGSKPDIISQLERGEDPW |
| 797 | ZN570_HUMAN | AVGLLKAMYQELVTERDVAVDESQEEWDCLDSSQRHLYSNVMLENYRILVSLGL CFSKPSVILLLEQGKAPWMVKRELTK |
| 798 | ZN675_HUMAN | GLLTERDVAIEFSLEEWQCLDTAQRNLYKNVILENYRNLVELGIAVSKQDLITC LEQEKEPLTVKRHEMVNEPPVMCSHF |
| 799 | ZN695_HUMAN | GLLAFRDVALEFSPEEWECLDPAQRSLYRDVMLENYRNLISLGEDSENMQFLFH SLAMSKPELIICLEARKEPWNVNTEK |
| 800 | ZN548_HUMAN | NLTEGRVVFEDVAIYFSQEEWGHLDEAQRLLYRDVMLENLALLSSLGSWHGAED EEAPSQQGFSVGVSEVTASKPCLSSQ |

TABLE 18-continued

Sequence listing.

| SEQ | Description | Sequence |
|---|---|---|
| 801 | ZN132_HUMAN | GPAQHTSWPCGSAVPTLKSMVTFEDVAVYFSQEEWELLDAAQRHLYHSVMLENL ELVTSLGSWHGVEGEGAHPKQNVSVE |
| 802 | ZN738_HUMAN | SGYPGAERNLLEYSYFEKGPLTFRDVVIEFSQEEWQCLDTAQQDLYRKVMLENF RNLVFLGIDVSKPDLITCLEQGKDPW |
| 803 | ZN420_HUMAN | ARKLVMFRDVAIDESQEEWECLDSAQRDLYRDVMLENYSNLVSLDLPSRCASKD LSPEKNTYETELSQWEMSDRLENCDL |
| 804 | ZN626_HUMAN | GPLQFRDVAIEFSLEEWHCLDTAQRNLYRNVMLENYSNLVELGITVSKPDLITC LEQGRKPLTMKRNEMIAKPSVMCSHF |
| 805 | ZN559_HUMAN | VAGWLTNYSQDSVTFEDVAVDETQEEWTLLDQTQRNLYRDVMLENYKNLVAVDW ESHINTKWSAPQQNFLQGKTSSVVEM |
| 806 | ZN460_HUMAN | AAAWMAPAQESVTFEDVAVTFTQEEWGQLDVTQRALYVEVMLETCGLLVALGDS TKPETVEPIPSHLALPEEVSLQEQLA |
| 807 | ZN268_HUMAN | VLEWLFISQEQPKITKSWGPLSFMDVFVDFTWEEWQLLDPAQKCLYRSVMLENY SNLVSLGYQHTKPDIIFKLEQGEELC |
| 808 | ZN304_HUMAN | AAAVLMDRVQSCVTFEDVEVYFSREEWELLEEAQRFLYRDVMLENFALVATLGE WCEAEHEAPSEQSVSVEGVSQVRTAE |
| 809 | ZIM2_HUMAN | AGSQFPDFKHLGTFLVFEELVTFEDVLVDESPEELSSLSAAQRNLYREVMLENY RNLVSLGHQFSKPDIISRLEEEESYA |
| 810 | ZN605_HUMAN | IQSQISFEDVAVDFTLEEWQLLNPTQKNLYRDVMLENYSNLVELEVWLDNPKMW LRDNQDNLKSMERGHKYDVFGKIENS |
| 811 | ZN844_HUMAN | DLVAFEDVAVNFTQEEWSLLDPSQKNLYREVMQETLRNLASIGEKWKDQNIEDQ YKNPRNNLRSLLGERVDENTEENHCG |
| 812 | SUMO5_HUMAN | KDEDIKLRVIGQDSSEIHFKVKMTTPLKKLKKSYCQRQGVPVNSLRELFEGQRI ADNHTPEELGMEEEDVIEVYQEQIGG |
| 813 | ZN101_HUMAN | DSVAFEDVAVNFTQEEWALLSPSQKNLYRDVTLETERNLASVGIQWKDQDIENL YQNLGIKLRSLVERLCGRKEGNEHRE |
| 814 | ZN783_HUMAN | RNFWILRLPPGSKGEAPKVPVTEDDVAVYFSELEWGKLEDWQKELYKHVMRGNY ETLVSLDYAISKPDILTRIERGEEPC |
| 815 | ZN417_HUMAN | AAAAPRRPTQQGTVTFEDVAVNFSQEEWCLLSEAQRCLYRDVMLENLALISSLG CWCGSKDEEAPCKQRISVQRESQSRT |
| 816 | ZN182_HUMAN | SGEDSGSFYSWQKAKREQGLVTFEDVAVDETQEEWQYLNPPQRTLYRDVMLETY SNLVFVGQQVTKPNLILKLEVEECPA |
| 817 | ZN823_HUMAN | DSVAFEDVAVNFTQEEWALLGPSQKSLYRNVMQETIRNLDCIEMKWEDQNIGDQ CQNAKRNLRSHTCEIKDDSQCGETFG |
| 818 | ZN177_HUMAN | AAGWLTTWSQNSVTFQEVAVDFSQEEWALLDPAQKNLYKDVMLENERNLASVGY QLCRHSLISKVDQEQLKTDERGILQG |
| 819 | ZN197_HUMAN | ENPRNQLMALMLLTAQPQELVMFEEVSVCFTSEEWACLGPIQRALYWDVMLENY GNVTSLEWETMTENEEVTSKPSSSQR |
| 820 | ZN717_HUMAN | LETYNSLVSLQELVSFEEVAVHFTWEEWQDLDDAQRTLYRDVMLETYSSLVSLG HCITKPEMIFKLEQGAEPWIVEETPN |
| 821 | ZN669_HUMAN | RHFRRPEPCREPLASPIQDSVAFEDVAVNFTQEEWALLDSSQKNLYREVMQETC RNLASVGSQWKDQNIEDHFEKPGKDI |
| 822 | ZN256_HUMAN | AAAELTAPAQGIVTFEDVAVYFSWKEWGLLDEAQKCLYHDVMLENLTLTTSLGG SGAGDEEAPYQQSTSPQRVSQVRIPK |
| 823 | ZN251_HUMAN | AATFQLPGHQEMPLTFQDVAVYFSQAEGRQLGPQQRALYRDVMLENYGNVASLG FPVPKPELISQLEQGKELWVLNLLGA |
| 824 | CBX4_HUMAN | RSEAGEPPSSLQVKPETPASAAVAVAAAAPTTTAEKPPAEAQDEPAESLSEFK PFFGNIIITDVTANCLTVTFKEYVTV |
| 825 | PCGF2_HUMAN | HRTTRIKITELNPHLMCALCGGYFIDATTIVECLHSFCKTCIVRYLETNKYCPM CDVQVHKTRPLLSIRSDKTLQDIVYK |

TABLE 18-continued

Sequence listing.

| SEQ | Description | Sequence |
|---|---|---|
| 826 | CDY2_HUMAN | ASQEFEVEAIVDKRQDKNGNTQYLVRWKGYDKQDDTWEPEQHLMNCEKCVHDEN RRQTEKQKKLTWTTTSRIFSNNARRR |
| 827 | CDYL2_HUMAN | ASGDLYEVERIVDKRKNKKGKWEYLIRWKGYGSTEDTWEPEHHLLHCEEFIDEF NGLHMSKDKRIKSGKQSSTSKLLRDS |
| 828 | HERC2_HUMAN | TLIRKADLENHNKDGGFWTVIDGKVYDIKDFQTQSLTGNSILAQFAGEDPVVAL EAALQFEDTRESMHAFCVGQYLEPDQ |
| 829 | ZN562_HUMAN | EKTKIGTMVEDHRSNSYQDSVTEDDVAVEFTPEEWALLDTTQKYLYRDVMLENY MNLASVDFFFCLTSEWEIQPRTKRSS |
| 830 | ZN461_HUMAN | AHELVMERDVAIDVSQEEWECLNPAQRNLYKEVMLENYSNLVSLGLSVSKPAVI SSLEQGKEPWMVVREETGRWCPGTWK |
| 831 | Z324A_HUMAN | AFEDVAVYFSQEEWGLLDTAQRALYRRVMLDNFALVASLGLSTSRPRVVIQLER GEEPWVPSGTDTTLSRTTYRRRNPGS |
| 832 | ZN766_HUMAN | AQLRRGHLTFRDVAIEFSQEEWKCLDPVQKALYRDVMLENYRNLVSLGICLPDL SIISMMKQRTEPWTVENEMKVAKNPD |
| 833 | ID2_HUMAN | SDHSLGISRSKTPVDDPMSLLYNMNDCYSKLKELVPSIPQNKKVSKMEILQHVI DYILDLQIALDSHPTIVSLHHQRPGQ |
| 834 | TOX_HUMAN | KDPNEPQKPVSAYALFFRDTQAAIKGQNPNATFGEVSKIVASMWDGLGEEQKQV YKKKTEAAKKEYLKQLAAYRASLVSK |
| 835 | ZN274_HUMAN | QEEKQEDAAICPVTVLPEEPVTFQDVAVDESREEWGLLGPTQRTEYRDVMLETE GHLVSVGWETTLENKELAPNSDIPEE |
| 836 | SCMH1_HUMAN | DASRLSGRDPSSWTVEDVMQFVREADPQLGPHADLERKHEIDGKALLLLRSDMM MKYMGLKLGPALKLSYHIDRLKQGKE |
| 837 | ZN214_HUMAN | AVTFEDVTIIFTWEEWKFLDSSQKRLYREVMWENYTNVMSVENWNESYKSQEEK FRYLEYENFSYWQGWWNAGAQMYENQ |
| 838 | CBX7_HUMAN | ELSAIGEQVFAVESIRKKRVRKGKVEYLVKWKGWPPKYSTWEPEEHILDPRLVM AYEEKEERDRASGYRKRGPKPKRLLL |
| 839 | ID1_HUMAN | GGAGARLPALLDEQQVNVLLYDMNGCYSRLKELVPTLPQNRKVSKVEILQHVID YIRDLQLELNSESEVGTPGGRGLPVR |
| 840 | CREM_HUMAN | VVMAASPGSLHSPQQLAEEATRKRELRLMKNREAAKECRRRKKEYVKCLESRVA VLEVQNKKLIEELETLKDICSPKTDY |
| 841 | SCX_HUMAN | GGGPGGRPGREPRQRHTANARERDRTNSVNTAFTALRTLIPTEPADRKLSKIET LRLASSYISHLGNVLLAGEACGDGQP |
| 842 | ASCL1_HUMAN | SGFGYSLPQQQPAAVARRNERERNRVKLVNLGFATLREHVPNGAANKKMSKVET LRSAVEYIRALQQLLDEHDAVSAAFQ |
| 843 | ZN764_HUMAN | APLPPRDPNGAGPEWREPGAVSFADVAVYFCREEWGCLRPAQRALYRDVMRETY GHLSALGIGGNKPALISWVEEEAELW |
| 844 | SCML2_HUMAN | KQGFSKDPSTWSVDEVIQFMKHTDPQISGPLADLERQHEIDGKALFLLKSDVMM KYMGLKLGPALKLCYYIEKLKEGKYS |
| 845 | TWST1_HUMAN | SGGGSPQSYEELQTQRVMANVRERQRTQSLNEAFAALRKIIPTLPSDKLSKIQT LKLAARYIDFLYQVLQSDELDSKMAS |
| 846 | CREB1_HUMAN | IAPGVVMASSPALPTQPAEEAARKREVRLMKNREAARECRRKKKEYVKCLENRV AVLENQNKTLIEELKALKDLYCHKSD |
| 847 | TERF1_HUMAN | SRIPVSKSQPVTPEKHRARKRQAWLWEEDKNLRSGVRKYGEGNWSKILLHYKEN NRTSVMLKDRWRTMKKLKLISSDSED |
| 848 | ID3_HUMAN | SLAIARGRGKGPAAEEPLSLLDDMNHCYSRLRELVPGVPRGTQLSQVEILQRVI DYILDLQVVLAEPAPGPPDGPHLPIQ |
| 849 | CBX8_HUMAN | GSGPPSSGGGLYRDMGAQGGRPSLIARIPVARILGDPEEESWSPSLTNLEKVVV TDVTSNFLTVTIKESNTDQGFFKEKR |
| 850 | CBX4_HUMAN | ELPAVGEHVFAVESIEKKRIRKGRVEYLVKWRGWSPKYNTWEPEENILDPRLLI AFQNRERQEQLMGYRKRGPKPKPLVV |

TABLE 18-continued

Sequence listing.

| SEQ | Description | Sequence |
|---|---|---|
| 851 | GSX1_HUMAN | VDSSSNQLPSSKRMRTAFTSTQLLELEREFASNMYLSRLRRIEIATYLNLSEKQ VKIWFQNRRVKHKKEGKGSNHRGGGG |
| 852 | NKX22_HUMAN | TPGGGGDAGKKRKRRVLFSKAQTYELERRFRQQRYLSAPEREHLASLIRLTPTQ VKIWFQNHRYKMKRARAEKGMEVTPL |
| 853 | ATF1_HUMAN | QTVVMTSPVTLTSQTTKTDDPQLKREIRLMKNREAARECRRKKKEYVKCLENRV AVLENQNKTLIEELKTLKDLYSNKSV |
| 854 | TWST2_HUMAN | KGSPSAQSFEELQSQRILANVRERQRTQSLNEAFAALRKIIPTLPSDKLSKIQT LKLAARYIDFLYQVLQSDEMDNKMTS |
| 855 | ZNF17_HUMAN | NLTEDYMVFEDVAIHFSQEEWGILNDVQRHLHSDVMLENFALLSSVGCWHGAKD EEAPSKQCVSVGVSQVTTLKPALSTQ |
| 856 | TOX3_HUMAN | KDPNEPQKPVSAYALFFRDTQAAIKGQNPNATFGEVSKIVASMWDSLGEEQKQV YKRKTEAAKKEYLKALAAYRASLVSK |
| 857 | TOX4_HUMAN | KDPNEPQKPVSAYALFERDTQAAIKGQNPNATFGEVSKIVASMWDSLGEEQKQV YKRKTEAAKKEYLKALAAYKDNQECQ |
| 858 | ZMYM3_HUMAN | LDGSTWDFCSEDCKSKYLLWYCKAARCHACKRQGKLLETIHWRGQIRHFCNQQC LLRFYSQQNQPNLDTQSGPESLLNSQ |
| 859 | 12BP1_HUMAN | ASVQASRRQWCYLCDLPKMPWAMVWDESEAVCRGCVNFEGADRIELLIDAARQL KRSHVLPEGRSPGPPALKHPATKDLA |
| 860 | RHXF1_HUMAN | MEGPQPENMQPRTRRTKFTLLQVEELESVFRHTQYPDVPTRRELAENLGVTEDK VRVWFKNKRARCRRHQRELMLANELR |
| 861 | SSX2_HUMAN | PKIMPKKPAEEGNDSEEVPEASGPQNDGKELCPPGKPTTSEKIHERSGPKRGEH AWTHRLRERKQLVIYEEISDPEEDDE |
| 862 | 12BPL_HUMAN | SAAQVSSSRRQSCYLCDLPRMPWAMIWDESEPVCRGCVNYEGADRIEFVIETAR QLKRAHGCFQDGRSPGPPPPVGVKTV |
| 863 | ZN680_HUMAN | PGPPGSLEMGPLTFRDVAIEFSLEEWQCLDTAQRNLYRKVMFENYRNLVELGIA VSKPHLITCLEQGKEPWNRKRQEMVA |
| 864 | CBX1_HUMAN | NKKKVEEVLEEEEEEYVVEKVLDRRVVKGKVEYLLKWKGFSDEDNTWEPEENLD CPDLIAEFLQSQKTAHETDKSEGGKR |
| 865 | TRI68_HUMAN | LANVVEKVRLLRLHPGMGLKGDLCERHGEKLKMFCKEDVLIMCEACSQSPEHEA HSVVPMEDVAWEYKWELHEALEHLKK |
| 866 | HXA13_HUMAN | VVSHPSDASSYRRGRKKRVPYTKVQLKELEREYATNKFITKDKRRRISATTNLS ERQVTIWFQNRRVKEKKVINKLKTTS |
| 867 | PHC3_HUMAN | ENSDLLPVAQTEPSIWTVDDVWAFIHSLPGCQDIADEFRAQEIDGQALLLLKED HLMSAMNIKLGPALKICARINSLKES |
| 868 | TCF24_HUMAN | AGPGGGSRSGSGRPAAANAARERSRVQTLRHAFLELQRTLPSVPPDTKLSKLDV LLLATTYIAHLTRSLQDDAEAPADAG |
| 869 | CBX3_HUMAN | QNGKSKKVEEAEPEEFVVEKVLDRRVVNGKVEYFLKWKGFTDADNTWEPEENLD CPELIEAFLNSQKAGKEKDGTKRKSL |
| 870 | HXB13_HUMAN | QHPPDACAFRRGRKKRIPYSKGQLRELEREYAANKFITKDKRRKISAATSLSER QITIWFQNRRVKEKKVLAKVKNSATP |
| 871 | HEY1_HUMAN | SMSPTTSSQILARKRRRGIIEKRRRDINNSLSELRRLVPSAFEKQGSAKLEKA EILQMTVDHLKMLHTAGGKGYFDAHA |
| 872 | PHC2_HUMAN | LVGMGHHELPSEPTKWNVEDVYEFIRSLPGCQEIAEEFRAQEIDGQALLLLKED HLMSAMNIKLGPALKIYARISMLKDS |
| 873 | ZNF81_HUMAN | PANEDAPQPGEHGSACEVSVSFEDVTVDESREEWQQLDSTQRRLYQDVMLENYS HLLSVGFEVPKPEVIFKLEQGEGPWT |
| 874 | FIGLA_HUMAN | GYSSTENLQLVLERRRVANAKERERIKNLNRGFARLKALVPFLPQSRKPSKVDI LKGATEYIQVLSDLLEGAKDSKKQDP |
| 875 | SAM11_HUMAN | EEAPAPEDVTKWTVDDVCSFVGGLSGCGEYTRVFREQGIDGETLPLLTEEHLLT NMGLKLGPALKIRAQVARRLGRVFYV |

TABLE 18-continued

Sequence listing.

| SEQ | Description | Sequence |
|---|---|---|
| 876 | KMT2B_HUMAN | GGTLAHTPRRSLPSHHGKKMRMARCGHCRGCLRVQDCGSCVNCLDKPKFGGPNT KKQCCVYRKCDKIEARKMERLAKKGR |
| 877 | HEY2_HUMAN | LNSPTTTSQIMARKKRRGIIEKRRRDRINNSLSELRRLVPTAFEKQGSAKLEKA EILQMTVDHLKMLQATGGKGYFDAHA |
| 878 | JDP2_HUMAN | QPVKSELDEEEERRKRRREKNKVAAARCRNKKKERTEFLQRESERLELMNAELK TQIEELKQERQQLILMLNRHRPTCIV |
| 879 | HXC13_HUMAN | LQPEVSSYRRGRKKRVPYTKVQLKELEKEYAASKFITKEKRRRISATTNLSERQ VTIWFQNRRVKEKKVVSKSKAPHLHS |
| 880 | ASCL4_HUMAN | LPVPLDSAFEPAFLRKRNERERQRVRCVNEGYARLRDHLPRELADKRLSKVETL RAAIDYIKHLQELLERQAWGLEGAAG |
| 881 | HHEX_HUMAN | SPFLQRPLHKRKGGQVRESNDQTIELEKKFETQKYLSPPERKRLAKMLQLSERQ VKTWFQNRRAKWRRLKQENPQSNKKE |
| 882 | HERC2_HUMAN | IAIATGSLHCVCCTEDGEVYTWGDNDEGQLGDGTTNAIQRPRLVAALQGKKVNR VACGSAHTLAWSTSKPASAGKLPAQV |
| 883 | GSX2_HUMAN | GGSDASQVPNGKRMRTAFTSTQLLELEREFSSNMYLSRLRRIEIATYLNLSEKQ VKIWFQNRRVKHKKEGKGTQRNSHAG |
| 884 | BIN1_HUMAN | RLDLPPGFMFKVQAQHDYTATDTDELQLKAGDVVLVIPFQNPEEQDEGWLMGVK ESDWNQHKELEKCRGVFPENFTERVP |
| 885 | ETV7_HUMAN | GICKLPGRLRIQPALWSREDVLHWLRWAEQEYSLPCTAEHGFEMNGRALCILTK DDERHRAPSSGDVLYELLQYIKTQRR |
| 886 | ASCL3_HUMAN | PNYRGCEYSYGPAFTRKRNERERQRVKCVNEGYAQLRHHLPEEYLEKRLSKVET LRAAIKYINYLQSLLYPDKAETKNNP |
| 887 | PHC1_HUMAN | LHGINPVFLSSNPSRWSVEEVYEFIASLQGCQEIAEEFRSQEIDGQALLLLKEE HLMSAMNIKLGPALKICAKINVLKET |
| 888 | OTP_HUMAN | QAGQQQGQQKQKRHRTRFTPAQLNELERSFAKTHYPDIFMREELALRIGLTESR VQVWFQNRRAKWKKRKKTTNVFRAPG |
| 889 | 12BP2_HUMAN | AAAVAVAAASRRQSCYLCDLPRMPWAMIWDFTEPVCRGCVNYEGADRVEFVIET ARQLKRAHGCFPEGRSPPGAAASAAA |
| 890 | VGLL2_HUMAN | FSSQTPASIKEEEGSPEKERPPEAEYINSRCVLFTYFQGDISSVVDEHESRALS QPSSYSPSCTSSKAPRSSGPWRDCSF |
| 891 | HXA11_HUMAN | DKAGGSSGQRTRKKRCPYTKYQIRELEREFFFSVYINKEKRLQLSRMLNLTDRQ VKIWFQNRRMKEKKINRDRLQYYSAN |
| 892 | PDLI4_HUMAN | GAPLSGLQGLPECTRCGHGIVGTIVKARDKLYHPECFMCSDCGLNLKQRGYFFL DERLYCESHAKARVKPPEGYDVVAVY |
| 893 | ASCL_HUMAN | RRPATAETGGGAAAVARRNERERNRVKLVNLGFQALRQHVPHGGASKKLSKVET LRSAVEYIRALQRLLAEHDAVRNALA |
| 894 | CDX4_HUMAN | TVQVTGKTRTKEKYRVVYTDHQRLELEKEFHCNRYITIQRKSELAVNLGLSERQ VKIWFQNRRAKERKMIKKKISQFENS |
| 895 | ZN860_HUMAN | EEAAQKRKEKEPGMALPQGHLTFRDVAIEFSLEEWKCLDPTQRALYRAMMLENY RNLHSVDISSKCMMKKESSTAQGNTE |
| 896 | LMBL4_HUMAN | DIRASQVARWTVDEVAEFVQSLLGCEEHAKCFKKEQIDGKAFLLLTQTDIVKVM KIKLGPALKIYNSILMFRHSQELPEE |
| 897 | PDIP3_HUMAN | LSPLEGTKMTVNNLHPRVTEEDIVELFCVCGALKRARLVHPGVAEVVFVKKDDA ITAYKKYNNRCLDGQPMKCNLHMNGN |
| 898 | NKX25_HUMAN | DNAERPRARRRRKPRVLESQAQVYELERRFKQQRYLSAPERDQLASVLKLTSTQ VKIWFQNRRYKCKRQRQDQTLELVGL |
| 899 | CEBPB_HUMAN | SQVKSKAKKTVDKHSDEYKIRRERNNIAVRKSRDKAKMRNLETQHKVLELTAEN ERLQKKVEQLSRELSTLRNLFKQLPE |
| 900 | ISL1_HUMAN | KRDYIRLYGIKCAKCSIGFSKNDFVMRARSKVYHIECFRCVACSRQLIPGDEFA LREDGLFCRADHDVVERASLGAGDPL |

TABLE 18-continued

Sequence listing.

| SEQ | Description | Sequence |
|---|---|---|
| 901 | CDX2_HUMAN | SLGSQVKTRTKDKYRVVYTDHQRLELEKEFHYSRYITIRRKAELAATLGLSERQ VKIWFQNRRAKERKINKKKLQQQQQQ |
| 902 | PROP1_HUMAN | QGGQRGRPHSRRRHRTTESPVQLEQLESAFGRNQYPDIWARESLARDTGLSEAR IQVWFQNRRAKQRKQERSLLQPLAHL |
| 903 | SIN3B_HUMAN | DALTYLDQVKIRFGSDPATYNGFLEIMKEFKSQSIDTPGVIRRVSQLFHEHPDL IVGFNAFLPLGYRIDIPKNGKLNIQS |
| 904 | SMBT1_HUMAN | RLHLDSNPLKWSVADVVRFIRSTDCAPLARIFLDQEIDGQALLLLTLPTVQECM DLKLGPAIKLCHHIERIKFAFYEQFA |
| 905 | HXC11_HUMAN | AKGAAPNAPRTRKKRCPYSKFQIRELEREFFENVYINKEKRLQLSRMLNLTDRQ VKIWFQNRRMKEKKLSRDRLQYFSGN |
| 906 | HXC10_HUMAN | TTGNWLTAKSGRKKRCPYTKHQTLELEKEFLENMYLTRERRLEISKTINLTDRQ VKIWFQNRRMKLKKMNRENRIRELTS |
| 907 | PRS6A_HUMAN | YLVSNVIELLDVDPNDQEEDGANIDLDSQRKGKCAVIKTSTRQTYFLPVIGLVD AEKLKPGDLVGVNKDSYLILETLPTE |
| 908 | VSX1_HUMAN | KASPTLGKRKKRRHRTVFTAHQLEELEKAFSEAHYPDVYAREMLAVKTELPEDR IQVWFQNRRAKWRKEKRWGGSSVMA |
| 909 | NKX23_HUMAN | EESERPKPRSRRKPRVLESQAQVFELERRFKQQRYLSAPEREHLASSLKLTSTQ VKIWFQNRRYKCKRQRQDKSLELGAH |
| 910 | MTG16_HUMAN | VVPGSRQEEVIDHKLTEREWAEEWKHLNNLLNCIMDMVEKTRRSLTVLRRCQEA DREELNHWARRYSDAEDTKKGPAPAA |
| 911 | HMX3_HUMAN | ESPEKKPACRKKKTRTVFSRSQVFQLESTFDMKRYLSSSERAGLAASLHLTETQ VKIWFQNRRNKWKRQLAAELEAANLS |
| 912 | HMX1_HUMAN | RGGVGVGGGRKKKTRTVESRSQVFQLESTEDLKRYLSSAERAGLAASLQLTETQ VKIWFQNRRNKWKRQLAAELEAASLS |
| 913 | KIF22_HUMAN | ELLAHGRQKILDLLNEGSARDLRSLQRIGPKKAQLIVGWRELHGPESQVEDLER VEGITGKQMESFLKANILGLAAGQRC |
| 914 | CSTF2_HUMAN | ESPYGETISPEDAPESISKAVASLPPEQMFELMKQMKLCVQNSPQEARNMLLQN PQLAYALLQAQVVMRIVDPEIALKIL |
| 915 | CEBPE_HUMAN | AGPLHKGKKAVNKDSLEYRLRRERNNIAVRKSRDKAKRRILETQQKVLEYMAEN ERLRSRVEQLTQELDTLRNLFRQIPE |
| 916 | DLX2_HUMAN | IRIVNGKPKKVRKPRTIYSSFQLAALQRRFQKTQYLALPERAELAASLGLTQTQ VKIWFQNRRSKFKKMWKSGEIPSEQH |
| 917 | ZMYM3_HUMAN | TVYQFCSPSCWTKFQRTSPEGGIHLSCHYCHSLFSGKPEVLDWQDQVFQFCCRD CCEDFKRLRGVVSQCEHCRQEKLLHE |
| 918 | PPARG_HUMAN | TMVDTEMPFWPTNFGISSVDLSVMEDHSHSFDIKPFTTVDESSISTPHYEDIPF TRTDPVVADYKYDLKLQEYQSAIKVE |
| 919 | PRIC1_HUMAN | GRHHAELLKPRCSACDEIIFADECTEAEGRHWHMKHFCCLECETVLGGQRYIMK DGRPFCCGCFESLYAEYCETCGEHIG |
| 920 | UNC4_HUMAN | DPDKESPGCKRRRTRTNFTGWQLEELEKAFNESHYPDVEMREALALRLDLVESR VQVWFQNRRAKWRKKENTKKGPGRPA |
| 921 | BARX2_HUMAN | TEQPTPRQKKPRRSRTIFTELQLMGLEKKFQKQKYLSTPDRLDLAQSLGLTQLQ VKTWYQNRRMKWKKMVLKGGQEAPTK |
| 922 | ALX3_HUMAN | SMELAKNKSKKRRNRTTFSTFQLEELEKVFQKTHYPDVYAREQLALRTDLTEAR VQVWFQNRRAKWRKRERYGKIQEGRN |
| 923 | TCF15_HUMAN | GGGGGAGPVVVVRQRQAANARERDRTQSVNTAFTALRTLIPTEPVDRKLSKIET VRLASSYIAHLANVLLLGDSADDGQP |
| 924 | TERA_HUMAN | IDDTVEGITGNLFEVYLKPYFLEAYRPIRKGDIFLVRGGMRAVEFKVVETDPSP YCIVAPDTVIHCEGEPIKREDEEESL |
| 925 | VSX2_HUMAN | SALNQTKKRKKRRHRTIFTSYQLEELEKAFNEAHYPDVYAREMLAMKTELPEDR IQVWFQNRRAKWRKREKCWGRSSVMA |

TABLE 18-continued

Sequence listing.

| SEQ | Description | Sequence |
|---|---|---|
| 926 | HXD12_HUMAN | DGLPWGAAPGRARKKRKPYTKQQIAELENEFLVNEFINRQKRKELSNRLNLSDQ QVKIWFQNRRMKKKRVVLREQALALY |
| 927 | CDX1_HUMAN | GGGGSGKTRTKDKYRVVYTDHQRLELEKEFHYSRYITIRRKSELAANLGLTERQ VKIWFQNRRAKERKVNKKKQQQQQPP |
| 928 | TCF23_HUMAN | TRAGGLALGRSEASPENAARERSRVRTLRQAFLALQAALPAVPPDTKLSKLDVL VLAASYIAHLTRTLGHELPGPAWPPE |
| 929 | ALX1_HUMAN | KCDSNVSSSKKRRHRTTFTSLQEELELEKVFQKTHYPDVYVREQLALRTELTEAR VQVWFQNRRAKWRKRERYGQIQQAKS |
| 930 | HXA10_HUMAN | NAANWLTAKSGRKKRCPYTKHQTLELEKEFLENMYLTRERRLEISRSVHLTDRQ VKIWFQNRRMKLKKMNRENRIRELTA |
| 931 | RX_HUMAN | LSEEEQPKKKHRRNRTTFTTYQLHELERAFEKSHYPDVYSREELAGKVNLPEVR VQVWFQNRRAKWRRQEKLEVSSMKLQ |
| 932 | CXXC5_HUMAN | HMAGLAEYPMQGELASAISSGKKKRKRCGMCAPCRRRINCEQCSSCRNRKTGHQ ICKFRKCEELKKKPSAALEKVMLPTG |
| 933 | SCML1_HUMAN | SITKHPSTWSVEAVVLELKQTDPLALCPLVDLERSHEIDGKALLLLTSDVLLKH LGVKLGTAVKLCYYIDRLKQGKCFEN |
| 934 | NFIL3_HUMAN | ACRRKREFIPDEKKDAMYWEKRRKNNEAAKRSREKRRLNDLVLENKLIALGEEN ATLKAELLSLKLKFGLISSTAYAQEI |
| 935 | DLX6_HUMAN | EIRFNGKGKKIRKPRTIYSSLQLQALNHRFQQTQYLALPERAELAASLGLTQTQ VKIWFQNKRSKFKKLLKQGSNPHESD |
| 936 | MTG8_HUMAN | GLHGTRQEEMIDHRLTDREWAEEWKHLDHLLNCIMDMVEKTRRSLTVLRRCQEA DREELNYWIRRYSDAEDLKKGGGSSS |
| 937 | CBX8_HUMAN | ELSAVGERVFAAEALLKRRIRKGRMEYLVKWKGWSQKYSTWEPEENILDARLLA AFEEREREMELYGPKKRGPKPKTELL |
| 938 | CEBPD_HUMAN | AREKSAGKRGPDRGSPEYRQRRERNNIAVRKSRDKAKRRNQEMQQKLVELSAEN EKLHQRVEQLTRDLAGLRQFFKQLPS |
| 939 | SEC13_HUMAN | SGGCDNLIKLWKEEEDGQWKEEQKLEAHSDWVRDVAWAPSIGLPTSTIASCSQD GRVFIWTCDDASSNTWSPKLLHKEND |
| 940 | FIP1_HUMAN | VKGVDLDAPGSINGVPLLEVDLDSFEDKPWRKPGADLSDYENYGENEDTWKAYC EKQKRIRMGLEVIPVTSTINKITAED |
| 941 | ALX4_HUMAN | KADSESNKGKKRRNRTTFSYQLEELEKVFQKTHYPDVYAREQLAMRTDLTEAR VQVWFQNRRAKWRKRERFGQMQQVRT |
| 942 | LHX3_HUMAN | TAKQREAEATAKRPRTTITAKQLETLKSAYNTSPKPARHVREQLSSETGLDMRV VQVWFQNRRAKEKRLKKDAGRQRWGQ |
| 943 | PRIC2_HUMAN | GRHHAECLKPRCAACDEIIFADECTEAEGRHWHMKHFCCFECETVLGGQRYIMK EGRPYCCHCFESLYAEYCDTCAQHIG |
| 944 | MAGI3_HUMAN | IIGGDRPDEFLQVKNVLKDGPAAQDGKIAPGDVIVDINGNCVLGHTHADVVQME QLVPVNQYVNLTLCRGYPLPDDSEDP |
| 945 | NELL1_HUMAN | CCPECDTRVTSQCLDQNGHKLYRSGDNWTHSCQQCRCLEGEVDCWPLTCPNLSC EYTAILEGECCPRCVSDPCLADNITY |
| 946 | PRRX1_HUMAN | LNSEEKKKRKQRRNRTTENSSQLQALERVFERTHYPDAFVREDLARRVNLTEAR VQVWFQNRRAKERRNERAMLANKNAS |
| 947 | MTG8R_HUMAN | GLNGGYQDELVDHRLTEREWADEWKHLDHALNCIMEMVEKTRRSMAVLRRCQES DREELNYWKRRYNENTELRKTGTELV |
| 948 | RAX2_HUMAN | GPGEEAPKKKHRRNRTTFTTYQLHQLERAFEASHYPDVYSREELAAKVHLPEVR VQVWFQNRRAKWRRQERLESGSGAVA |
| 949 | DLX3_HUMAN | VRMVNGKPKKVRKPRTIYSSYQLAALQRRFQKAQYLALPERAELAAQLGLTQTQ VKIWFQNRRSKFKKLYKNGEVPLEHS |
| 950 | DLX1_HUMAN | EVRENGKGKKIRKPRTIYSSLQLQALNRRFQQTQYLALPERAELAASLGLTQTQ VKIWFQNKRSKFKKLMKQGGAALEGS |

TABLE 18-continued

Sequence listing.

| SEQ | Description | Sequence |
|-----|-------------|----------|
| 951 | NKX26_HUMAN | GRSEQPKARQRRKPRVLFSQAQVLALERRFKQQRYLSAPEREHLASALQLTSTQ VKIWFQNRRYKCKRQRQDKSLELAGH |
| 952 | NAB1_HUMAN | LPRTLGELQLYRILQKANLLSYFDAFIQQGGDDVQQLCEAGEEEFLEIMALVGM ASKPLHVRRLQKALRDWVTNPGLENQ |
| 953 | SAMD7_HUMAN | NLSLDEDIQKWTVDDVHSFIRSLPGCSDYAQVFKDHAIDGETLPLLTEEHLRGT MGLKLGPALKIQSQVSQHVGSMFYKK |
| 954 | PITX3_HUMAN | SPEDGSLKKKQRRQRTHFTSQQLQELEATFQRNRYPDMSTREEIAVWTNLTEAR VRVWFKNRRAKWRKRERSQQAELCKG |
| 955 | WDR5_HUMAN | SNLLVSASDDKTLKIWDVSSGKCLKTLKGHSNYVFCCNENPQSNLIVSGSFDES VRIWDVKTGKCLKTLPAHSDPVSAVH |
| 956 | MEOX2_HUMAN | GNYKSEVNSKPRKERTAFTKEQIRELEAEFAHHNYLTRLRRYEIAVNLDLTERQ VKVWFQNRRMKWRVKGGQQGAAARE |
| 957 | NAB2_HUMAN | LPRTLGELQLYRVLQRANLLSYYETFIQQGGDDVQQLCEAGEEEFLEIMALVGM ATKPLHVRRLQKALREWATNPGLESQ |
| 958 | DHX8_HUMAN | PEEPTIGDIYNGKVTSIMQFGCFVQLEGLRKRWEGLVHISELRREGRVANVADV VSKGQRVKVKVLSFTGTKTSLSMKDV |
| 959 | FOXA2_HUMAN | YAFNHPFSINNLMSSEQQHHHSHHHHQPHKMDLKAYEQVMHYPGYGSPMPGSLA MGPVTNKTGLDASPLAADTSYYQGVY |
| 960 | CBX6_HUMAN | TAAAGPAPPTAPEPAGASSEPEAGDWRPEMSPCSNVVVTDVTSNLLTVTIKEFC NPEDFEKVAAGVAGAAGGGGSIGASK |
| 961 | EMX2_HUMAN | FLLHNALARKPKRIRTAFSPSQLLRLEHAFEKNHYVVGAERKQLAHSLSLTETQ VKVWFQNRRTKFKRQKLEEEGSDSQQ |
| 962 | CPSF6_HUMAN | KRIALYIGNLTWWTTDEDLTEAVHSLGVNDILEIKFFENRANGQSKGFALVGVG SEASSKKLMDLLPKRELHGQNPVVTP |
| 963 | HXC12_HUMAN | SGAPWYPINSRSRKKRKPYSKLQLAELEGEFLVNEFITRQRRRELSDRINLSDQ QVKIWFQNRRMKKKRLLLREQALSFF |
| 964 | KDM4B_HUMAN | SDNLYPESITSRDCVQLGPPSEGELVELRWTDGNLYKAKFISSVTSHIYQVEFE DGSQLTVKRGDIFTLEEELPKRVRSR |
| 965 | LMBL3_HUMAN | GIPASKVSKWSTDEVSEFIQSLPGCEEHGKVFKDEQIDGEAFLLMTQTDIVKIM SIKLGPALKIENSILMEKAAEKNSHN |
| 966 | PHX2A_HUMAN | EPSGLHEKRKQRRIRTTFTSAQLKELERVFAETHYPDIYTREELALKIDLTEAR VQVWFQNRRAKFRKQERAASAKGAAG |
| 967 | EMX1_HUMAN | LLLHGPFARKPKRIRTAFSPSQLLRLERAFEKNHYVVGAERKQLAGSLSLSETQ VKVWFQNRRTKYKRQKLEEEGPESEQ |
| 968 | NC2B_HUMAN | SSGNDDDLTIPRAAINKMIKETLPNVRVANDARELVVNCCTEFIHLISSEANEI CNKSEKKTISPEHVIQALESLGFGSY |
| 969 | DLX4_HUMAN | ERRPQAPAKKLRKPRTIYSSLQLQHLNQRFQHTQYLALPERAQLAAQLGLTQTQ VKIWFQNKRSKYKKLLKQNSGGQEGD |
| 970 | SRY_HUMAN | NVQDRVKRPMNAFIVWSRDQRRKMALENPRMRNSEISKQLGYQWKMLTEAEKWP FFQEAQKLQAMHREKYPNYKYRPRRK |
| 971 | ZN777_HUMAN | EITRLAVWAAVQAVERKLEAQAMRLLTLEGRTGTNEKKIADCEKTAVEFANHLE SKWVVLGTLLQEYGLLQRRLENMENL |
| 972 | NELL1_HUMAN | CEKDIDECSEGIIECHNHSRCVNLPGWYHCECRSGFHDDGTYSLSGESCIDIDE CALRTHTCWNDSACINLAGGEDCLCP |
| 973 | ZN398_HUMAN | AAISLWTVVAAVQAIERKVEIHSRRLLHLEGRTGTAEKKLASCEKTVTELGNQL EGKWAVLGTLLQEYGLLQRRLENLEN |
| 974 | GATA3_HUMAN | GQNRPLIKPKRRLSAARRAGTSCANCQTTTTTLWRRNANGDPVCNACGLYYKLH NINRPLTMKKEGIQTRNRKMSSKSKK |
| 975 | BSH_HUMAN | HAELPGKHCRRRKARTVESDSQLSGLEKRFEIQRYLSTPERVELATALSLSETQ VKTWFQNRRMKHKKQLRKSQDEPKAP |

TABLE 18-continued

Sequence listing.

| SEQ | Description | Sequence |
|---|---|---|
| 976 | SF3B4_HUMAN | QDATVYVGGLDEKVSEPLLWELFLQAGPVVNTHMPKDRVTGQHQGYGFVEFLSE EDADYAIKIMNMIKLYGKPIRVNKAS |
| 977 | TEAD1_HUMAN | PIDNDAEGVWSPDIEQSFQEALAIYPPCGRRKIILSDEGKMYGRNELIARYIKL RTGKTRTRKQVSSHIQVLARRKSRDE |
| 978 | TEAD3_HUMAN | GLDNDAEGVWSPDIEQSFQEALAIYPPCGRRKIILSDEGKMYGRNELIARYIKL RTGKTRTRKQVSSHIQVLARKKVREY |
| 979 | RGAP1_HUMAN | DSVGTPQSNGGMRLHDFVSKTVIKPESCVPCGKRIKFGKLSLKCRDCRVVSHPE CRDRCPLPCIPTLIGTPVKIGEGMLA |
| 980 | PHF1_HUMAN | SAPHSMTASSSSVSSPSPGLPRRSAPPSPLCRSLSPGTGGGVRGGVGYLSRGDP VRVLARRVRPDGSVQYLVEWGGGIF |
| 981 | FOXA1_HUMAN | GDPHYSENHPESINNLMSSSEQQHKLDFKAYEQALQYSPYGSTLPASLPLGSAS VTTRSPIEPSALEPAYYQGVYSRPVL |
| 982 | GATA2_HUMAN | GQNRPLIKPKRRLSAARRAGTCCANCQTTTTTLWRRNANGDPVCNACGLYYKLH NVNRPLTMKKEGIQTRNRKMSNKSKK |
| 983 | FOXO3_HUMAN | DSLSGSSLYSTSANLPVMGHEKFPSDLDLDMENGSLECDMESIIRSELMDADGL DENFDSLISTQNVVGLNVGNFTGAKQ |
| 984 | ZN212_HUMAN | TEISLWTVVAAIQAVEKKMESQAARLQSLEGRTGTAEKKLADCEKMAVEFGNQL EGKWAVLGTLLQEYGLLQRRLENVEN |
| 985 | IRX4_HUMAN | MDSGTRRKNATRETTSTLKAWLQEHRKNPYPTKGEKIMLAIITKMTLTQVSTWE ANARRRLKKENKMTWPPRNKCADEKR |
| 986 | ZBED6_HUMAN | NIEKQIYLPSTRAKTSIVWHFFHVDPQYTWRAICNLCEKSVSRGKPGSHLGTST LQRHLQARHSPHWTRANKFGVASGEE |
| 987 | LHX4_HUMAN | AKQNDDSEAGAKRPRTTITAKQLETLKNAYKNSPKPARHVREQLSSETGLDMRV VQVWFQNRRAKEKRLKKDAGRHRWGQ |
| 988 | SIN3A_HUMAN | DALSYLDQVKLQFGSQPQVYNDFLDIMKEFKSQSIDTPGVISRVSQLFKGHPDL IMGFNTFLPPGYKIEVQTNDMVNVTT |
| 989 | RBBP7_HUMAN | DDHTVCLWDINAGPKEGKIVDAKAIFTGHSAVVEDVAWHLLHESLEGSVADDQK LMIWDTRSNTTSKPSHLVDAHTAEVN |
| 990 | NKX61_HUMAN | GSILLDKDGKRKHTRPTFSGQQIFALEKTFEQTKYLAGPERARLAYSLGMTESQ VKVWFQNRRTKWRKKHAAEMATAKKK |
| 991 | TRI68_HUMAN | DPTALVEAIVEEVACPICMTFLREPMSIDCGHSFCHSCLSGLWEIPGESQNWGY TCPLCRAPVQPRNLRPNWQLANVVEK |
| 992 | R51A1_HUMAN | QSLPKKVSLSSDTTRKPLEIRSPSAESKKPKWVPPAASGGSRSSSSPLVVVSVK SPNQSLRLGLSRLARVKPLHPNATST |
| 993 | MB3L1_HUMAN | AKSSQRKQRDCVNQCKSKPGLSTSIPLRMSSYTFKRPVTRITPHPGNEVRYHQW EESLEKPQQVCWQRRLQGLQAYSSAG |
| 994 | DLX5_HUMAN | VRMVNGKPKKVRKPRTIYSSFQLAALQRRFQKTQYLALPERAELAASLGLTQTQ VKIWFQNKRSKIKKIMKNGEMPPEHS |
| 995 | NOTC1_HUMAN | LQCNNHACGWDGGDCSLNENDPWKNCTQSLQCWKYFSDGHCDSQCNSAGCLEDG FDCQRAEGQCNPLYDQYCKDHFSDGH |
| 996 | TERF2_HUMAN | ETWVEEDELFQVQAAPDEDSTTNITKKQKWTVEESEWVKAGVQKYGEGNWAAIS KNYPFVNRTAVMIKDRWRTMKRLGMN |
| 997 | ZN282_HUMAN | AEISLWTVVAAIQAVERKVDAQASQLLNLEGRTGTAEKKLADCEKTAVEFGNHM ESKWAVLGTLLQEYGLLQRRLENLEN |
| 998 | RGS12_HUMAN | LEKRTLFRLDLVPINRSVGLKAKPTKPVTEVLRPVVARYGLDLSGLLVRLSGEK EPLDLGAPISSLDGQRVVLEEKDPSR |
| 999 | ZN840_HUMAN | PNCLSSSMQLPHGGGRHQELVRERDVAVVESPEEWDHLTPEQRNLYKDVMLDNC KYLASLGNWTYKAHVMSSLKQGKEPW |
| 1000 | SPI2B_HUMAN | DDYKEGDLRIMPESSESPPTEREPGGVVDGLIGKHVEYTKEDGSKRIGMVIHQV EAKPSVYFIKFDDDFHIYVYDLVKKS |

TABLE 18-continued

Sequence listing.

| SEQ | Description | Sequence |
|---|---|---|
| 1001 | PAX7_HUMAN | SEPDLPLKRKQRRSRTTFTAEQLEELEKAFERTHYPDIYTREELAQRTKLTEAR VQVWFSNRRARWRKQAGANQLAAFNH |
| 1002 | NKX62_HUMAN | AGGVLDKDGKKKHSRPTFSGQQIFALEKTFEQTKYLAGPERARLAYSLGMTESQ VKVWFQNRRTKWRKRHAVEMASAKKK |
| 1003 | ASXL2_HUMAN | DVMSFSVTVTTIPASQAMNPSSHGQTIPVQAFSEENSIEGTPSKCYCRLKAMIM CKGCGAFCHDDCIGPSKLCVSCLVVR |
| 1004 | FOXO1_HUMAN | GGYSSVSSCNGYGRMGLLHQEKLPSDLDGMFIERLDCDMESIIRNDLMDGDTLD FNFDNVLPNQSFPHSVKTTTHSWVSG |
| 1005 | GATA3_HUMAN | GGSPTGFGCKSRPKARSSTGRECVNCGATSTPLWRRDGTGHYLCNACGLYHKMN GQNRPLIKPKRRLSAARRAGTSCANC |
| 1006 | GATA1_HUMAN | GQNRPLIRPKKRLIVSKRAGTQCTNCQTTTTTLWRRNASGDPVCNACGLYYKLH QVNRPLTMRKDGIQTRNRKASGKGKK |
| 1007 | ZMYM5_HUMAN | PVALLRKQNFQPTAQQQLTKPAKITCANCKKPLQKGQTAYQRKGSAHLFCSTTC LSSFSHKRTQNTRSIICKKDASTKKA |
| 1008 | ZN783_HUMAN | TEITLWTVVAAIQALEKKVDSCLTRLLTLEGRTGTAEKKLADCEKTAVEFGNQL EGKWAVLGTLLQEYGLLQRRLENVEN |
| 1009 | SPI2B_HUMAN | KKQRGRPSSQPRRNIVGCRISHGWKEGDEPITQWKGTVLDQVPINPSLYLVKYD GIDCVYGLELHRDERVLSLKILSDRV |
| 1010 | LRP1_HUMAN | WTCDLDDDCGDRSDESASCAYPTCFPLTQFTCNNGRCININWRCDNDNDCGDNS DEAGCSHSCSSTQFKCNSGRCIPEHW |
| 1011 | MIXL1_HUMAN | PKGAAAPSASQRRKRTSFSAEQLQLLELVERRTRYPDIHLRERLAALTLLPESR IQVWFQNRRAKSRRQSGKSFQPLARP |
| 1012 | SGT1_HUMAN | KIKYDWYQTESQVVITLMIKNVQKNDVNVEFSEKELSALVKLPSGEDYNLKLEL LHPIIPEQSTFKVLSTKIEIKLKKPE |
| 1013 | LMCD1_HUMAN | DPSKEVEYVCELCKGAAPPDSPVVYSDRAGYNKQWHPTCFVCAKCSEPLVDLIY FWKDGAPWCGRHYCESLRPRCSGCDE |
| 1014 | CEBPA_HUMAN | GSGAGKAKKSVDKNSNEYRVRRERNNIAVRKSRDKAKQRNVETQQKVLELTSDN DRLRKRVEQLSRELDTLRGIFRQLPE |
| 1015 | GATA2_HUMAN | GPASSFTPKQRSKARSCSEGRECVNCGATATPLWRRDGTGHYLCNACGLYHKMN GQNRPLIKPKRRLSAARRAGTCCANC |
| 1016 | SOX14_HUMAN | KPSDHIKRPMNAFMVWSRGQRRKMAQENPKMHNSEISKRLGAEWKLLSEAEKRP YIDEAKRLRAQHMKEHPDYKYRPRRK |
| 1017 | WTIP_HUMAN | LYSGFQQTADKCSVCGHLIMEMILQALGKSYHPGCFRCSVCNECLDGVPFTVDV ENNIYCVRDYHTVFAPKCASCARPIL |
| 1018 | PRP19_HUMAN | HPSQDLVESASPDATIRIWSVPNASCVQVVRAHESAVTGLSLHATGDYLLSSSD DQYWAFSDIQTGRVLTKVTDETSGCS |
| 1019 | CBX6_HUMAN | ELSAVGERVFAAESIIKRRIRKGRIEYLVKWKGWAIKYSTWEPEENILDSRLIA AFEQKERERELYGPKKRGPKPKTELL |
| 1020 | NKX11_HUMAN | RTGSDSKSGKPRRARTAFTYEQLVALENKFKATRYLSVCERLNLALSLSLTETQ VKIWFQNRRTKWKKQNPGADTSAPTG |
| 1021 | RBBP4_HUMAN | VWDLSKIGEEQSPEDAEDGPPELLFIHGGHTAKISDESWNPNEPWVICSVSEDN IMQVWQMAENIYNDEDPEGSVDPEGQ |
| 1022 | DMRT2_HUMAN | ERCTPAGGGAEPRKLSRTPKCARCRNHGVVSCLKGHKRFCRWRDCQCANCLLVV ERQRVMAAQVALRRQQATEDKKGLSG |
| 1023 | SMCA2_HUMAN | SQPGALIPGDPQAMSQPNRGPSPFSPVQLHQLRAQILAYKMLARGQPLPETLQL AVQGKRTLPGLQQQQQQQQQQQQQQQQ |
| 1024 | ZNF10 | MDAKSLTAWSRTLVTFKDVFVDFTREEWKLLDTAQQIVYRNVMLENYKNLVSLG YQLTKPDVILRLEKGEEPWLVEREIHQETHPDSETAFEIKSSVSSRSIFKDKQS CDIKMEGMARNDLWYLSLEEVWKCRDQLDKYQENPERHLRQVAFTQKKVLTQER VSESGKYGGNCLLPAQLVLREYFHKRDSHTKSLKHDLVLNGHQDSCASNSNECG QTFCQNIHLIQFARTHTGDKSYKCPDNDNSLTHGSSLGISKGIHREKPYECKEC GKFFSWRSNLTRHQLIHTGEKPYECKECGKSESRSSHLIGHQKTHTGEEPYECK |

TABLE 18-continued

Sequence listing.

| SEQ | Description | Sequence |
|---|---|---|
| | | ECGKSFSWFSHLVTHQRTHTGDKLYTCNQCGKSFVHSSRLIRHQRTHTGEKPYE<br>CPECGKSFRQSTHLILHQRTHVRVRPYECNECGKSYSQRSHLVVHHRIHTGLKP<br>FECKDCGKCESRSSHLYSHQRTHTGEKPYECHDCGKSFSQSSALIVHQRIHTGE<br>KPYECCQCGKAFIRKNDLIKHQRIHVGEETYKCNQCGIIFSQNSPFIVHQIAHT<br>GEQFLTCNQCGTALVNTSNLIGYQTNHIRENAY |
| 1025 | EED_HUMAN | MSEREVSTAPAGTDMPAAKKQKLSSDENSNPDLSGDENDDAVSIESGINTERPD<br>TPTNTPNAPGRKSWGKGKWKSKKCKYSFKCVNSLKEDHNQPLFGVQFNWHSKEG<br>DPLVFATVGSNRVTLYECHSQGEIRLLQSYVDADADENFYTCAWTYDSNTSHPL<br>LAVAGSRGIIRIINPITMQCIKHYVGHGNAINELKFHPRDPNLLLSVSKDHALR<br>LWNIQTDTLVAIFGGVEGHRDEVLSADYDLLGEKIMSCGMDHSLKLWRINSKRM<br>MNAIKESYDYNPNKTNRPFISQKIHFPDFSTRDIHRNYVDCVRWLGDLILSKSC<br>ENAIVCWKPGKMEDDIDKIKPSESNVTILGREDYSQCDIWYMRESMDFWQKMLA<br>LGNQVGKLYVWDLEVEDPHKAKCTTLTHHKCGAAIRQTSESRDSSILIAVCDDA<br>SIWRWDRLR |
| 1026 | RCOR1_HUMAN | MPAMVEKGPEVSGKRRGRNNAAASASAAAASAAAASAACASPAATAASGAAASSA<br>SAAAASAAAAPNNGQNKSLAAAAPNGNSSSNSWEEGSSGSSSDEEHGGGGMRVG<br>PQYQAVVPDFDPAKLARRSQERDNLGMLVWSPNQNLSEAKLDEYIAIAKEKHGY<br>NMEQALGMLFWHKHNIEKSLADLPNFTPFPDEWTVEDKVLFEQAFSFHGKTFHR<br>IQQMLPDKSIASLVKFYYSWKKTRTKTSVMDRHARKQKREREESEDELEEANGN<br>NPIDIEVDQNKESKKEVPPTETVPQVKKEKHSTQAKNRAKRKPPKGMFLSQEDV<br>EAVSANATAATTVLRQLDMELVSVKRQIQNIKQTNSALKEKLDGGIEPYRLPEV<br>IQKCNARWTTEEQLLAVQAIRKYGRDFQAISDVIGNKSVVQVKNFFVNYRRREN<br>IDEVLQEWEAEHGKEETNGPSNQKPVKSPDNSIKMPEEEDEAPVLDVRYASAS |
| 1027 | human DNMT1 | MPARTAPARVPTLAVPAISLPDDVRRRLKDLERDSLTEKECVKEKLNLLHEFLQ<br>TEIKNQLCDLETKLRKEELSEEGYLAKVKSLLNKDLSLENGAHAYNREVNGRLE<br>NGNQARSEARRVGMADANSPPKPLSKPRTPRRSKSDGEAKPEPSPSPRITRKST<br>RQTTITSHFAKGPAKRKPQEESERAKSDESIKEEDKDQDEKRRRVTSRERVARP<br>LPAEEPERAKSGTRTEKEEERDEKEEKRLRSQTKEPTPKQKLKEEPDREARAGV<br>QADEDEDGDEKDEKKHRSQPKDLAAKRRPEEKEPEKVNPQISDEKDEDEKEEKR<br>RKTTPKEPTEKKMARAKTVMNSKTHPPKCIQCGQYLDDPLKYGQHPPDAVDEPQ<br>MLTNEKLSIFDANESGFESYEALPQHKLTCFSVYCKHGHLCPIDTGLIEKNIEL<br>FFSGSAKPIYDDDPSLEGGVNGKNLGPINEWWITGEDGGEKALIGESTSFAEYI<br>LMDPSPEYAPIFGLMQEKIYISKIVVEFLQSNSDSTYEDLINKIETTVPPSGLN<br>LNRFTEDSLLRHAQFVVEQVESYDEAGDSDEQPIFLTPCMRDLIKLAGVTLGQR<br>RAQARRQTIRHSTREKDRGPTKATTTKLVYQIFDTFFAEQIEKDDREDKENAFK<br>RRRCGVCEVCQQPECGKCKACKDMVKFGGSGRSKQACQERRCPNMAMKEADDDE<br>EVDDNIPEMPSPKKMHQGKKKKQNKNRISWVGEAVKTDGKKSYYKKVCIDAETL<br>EVGDCVSVIPDDSSKPLYLARVTALWEDSSNGQMFHAHWFCAGTDTVLGATSDP<br>LELFLVDECEDMQLSYIHSKVKVIYKAPSENWAMEGGMDPESLLEGDDGKTYFY<br>QLWYDQDYARFESPPKTQPTEDNKFKFCVSCARLAEMRQKEIPRVLEQLEDLDS<br>RVLYYSATKNGILYRVGDGVYLPPEAFTENIKLSSPVKRPRKEPVDEDLYPEHY<br>RKYSDYIKGSNLDAPEPYRIGRIKEIFCPKKSNGRPNETDIKIRVNKFYRPENT<br>HKSTPASYHADINLLYWSDEEAVVDFKAVQGRCTVEYGEDLPECVQVYSMGGPN<br>RFYFLEAYNAKSKSFEDPPNHARSPGNKGKGKGKGKGKPKSQACEPSEPEIEIK<br>LPKLRTLDVFSGCGGLSEGFHQAGISDTLWAIEMWDPAAQAFRLNNPGSTVETE<br>DCNILLKLVMAGETTNSRGQRLPQKGDVEMLCGGPPCQGFSGMNRENSRTYSKE<br>KNSLVVSFLSYCDYYRPRFFLLENVRNFVSFKRSMVLKLTLRCLVRMGYQCTFG<br>VLQAGQYGVAQTRRRAIILAAAPGEKLPLFPEPLHVFAPRACQLSVVVDDKKEV<br>SNITRLSSGPERTITVRDTMSDLPEVRNGASALEISYNGEPQSWFQRQLRGAQY<br>QPILRDHICKDMSALVAARMRHIPLAPGSDWRDLPNIEVRLSDGTMARKLRYTH<br>HDRKNGRSSSGALRGVCSCVEAGKACDPAARQENTLIPWCLPHTGNRHNHWAGL<br>YGRLEWDGFFSTTVTNPEPMGKQGRVLHPEQHRVVSVRECARSQGFPDTYRLFG<br>NILDKHRQVGNAVPPPLAKAIGLEIKLCMLAKARESASAKIKEEEAAKD |
| 1028 | human DNMT3A | MPAMPSSGPGDTSSSAAEREEDRKDGEEQEEPRGKEERQEPSTTARKVGRPGRK<br>RKHPPVESGDTPKDPAVISKSPSMAQDSGASELLPNGDLEKRSEPQPEEGSPAG<br>GQKGGAPAEGEGAAETLPEASRAVENGCCTPKEGRGAPAEAGKEQKETNIESMK<br>MEGSRGRLRGGLGWESSLRQRPMPRLTFQAGDPYYISKRKRDEWLARWKREAEK<br>KAKVIAGMNAVEENQGPGESQKVEEASPPAVQQPTDPASPTVATTPEPVGSDAG<br>DKNATKAGDDEPEYEDGRGFGIGELVWGKLRGFSWWPGRIVSWWMTGRSRAAEG<br>TRWVMWFGDGKFSVVCVEKLMPLSSFCSAFHQATYNKQPMYRKAIYEVLQVASS<br>RAGKLFPVCHDSDESDTAKAVEVQNKPMIEWALGGFQPSGPKGLEPPEEEKNPY<br>KEVYTDMWVEPEAAAYAPPPPAKKPRKSTAEKPKVKEIIDERTRERLVYEVRQK<br>CRNIEDICISCGSLNVTLEHPLFVGGMCQNCKNCFLECAYQYDDDGYQSYCTIC<br>CGGREVLMCGNNNCCRCFCVECVDLLVGPGAAQAAIKEDPWNCYMCGHKGTYGL<br>LRRREDWPSRLQMFFANNHDQEFDPPKVYPPVPAEKRKPIRVLSLEDGIATGLL<br>VLKDLGIQVDRYIASEVCEDSITVGMVRHQKIMYVGDVRSVTQKHIQEWGPED<br>LVIGGSPCNDLSIVNPARKGLYEGTGRLFFEFYRLLHDARPKEGDDRPFFWLFE<br>NVVAMGVSDKRDISRFLESNPVMIDAKEVSAAHRARYFWGNLPGMNRPLASTVN<br>DKLELQECLEHGRIAKFSKVRTITTRSNSIKQGKDQHFPVEMNEKEDILWCTEM<br>ERVFGFPVHYTDVSNMSRLARQRLLGRSWSVPVIRHLFAPLKEYFACV |

TABLE 18-continued

Sequence listing.

| SEQ | Description | Sequence |
|---|---|---|
| 1029 | human DNMT3A catalytic domain | NHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNPA<br>RKGLYEGTGRLFFEFYRLLHDARPKEGDDRPFFWLFENVVAMGVSDKRDISREL<br>ESNPVMIDAKEVSAAHRARYFWGNLPGMNRPLASTVNDKLELQECLEHGRIAKF<br>SKVRTITTRSNSIKQGKDQHFPVEMNEKEDILWCTEMERVFGFPVHYTDVSNMS<br>RLARQRLLGRSWSVPVIRHLFAPLKEYFACV |
| 1030 | human DNMT3B | MKGDTRHLNGEEDAGGREDSILVNGACSDQSSDSPPILEAIRTPEIRGRRSSSR<br>LSKREVSSLLSYTQDLTGDGDGEDGDGSDTPVMPKLFRETRTRSESPAVRTRNN<br>NSVSSRERHRPSPRSTRGRQGRNHVDESPVEFPATRSLRRRATASAGTPWPSPP<br>SSYLTIDLTDDTEDTHGTPQSSSTPYARLAQDSQQGGMESPQVEADSGDGDSSE<br>YQDGKEFGIGDLVWGKIKGFSWWPAMVVSWKATSKRQAMSGMRWVQWFGDGKES<br>EVSADKLVALGLESQHENLATENKLVSYRKAMYHALEKARVRAGKTFPSSPGDS<br>LEDQLKPMLEWAHGGFKPTGIEGLKPNNTQPVVNKSKVRRAGSRKLESRKYENK<br>TRRRTADDSATSDYCPAPKRLKTNCYNNGKDRGDEDQSREQMASDVANNKSSLE<br>DGCLSCGRKNPVSFHPLFEGGLCQTCRDRFLELFYMYDDDGYQSYCTVCCEGRE<br>LLLCSNTSCCRCFCVECLEVLVGTGTAAEAKLQEPWSCYMCLPQRCHGVLRRRK<br>DWNVRLQAFFTSDTGLEYEAPKLYPAIPAARRRPIRVLSLEDGIATGYLVLKEL<br>GIKVGKYVASEVCEESIAVGTVKHEGNIKYVNDVRNITKKNIEEWGPFDLVIGG<br>SPCNDLSNVNPARKGLYEGTGRLFFEFYHLLNYSRPKEGDDRPFFWMFENVVAM<br>KVGDKRDISRELECNPVMIDAIKVSAAHRARYFWGNLPGMNRPVIASKNDKLEL<br>QDCLEYNRIAKLKKVQTITTTKSNSIKQGKNQLFPVVMNGKEDVLWCTELERIFG<br>FPVHYTDVSNMGRGARQKLLGRSWSVPVIRHLFAPLKDYFACE |
| 1031 | mouse DNMT3C | MRGGSRHLSNEEDVSGCEDCIIISGTCSDQSSDPKTVPLTQVLEAVCTVENRGC<br>RTSSQPSKRKASSLISYVQDLTGDGDEDRDGEVGGSSGSGTPVMPQLFCETRIP<br>SKTPAPLSWQANTSASTPWLSPASPYPIIDLTDEDVIPQSISTPSVDWSQDSHQ<br>EGMDTTQVDAESRDGGNIEYQVSADKLLLSQCILAAFYKLVPYRESTYRTLEK<br>ARVRAGKACPSSPGESLEDQLKPMLEWAHGGFKPTGIEGLKPNKKQPENKSRRR<br>TTNDPAASESSSPPKRLKTNSYGGKDRGEDEESREQMASDVTNNKGNLEDHCLSC<br>GRKDPVSFHPLFEGGLCQSCRDRELELFYMYDEDGYQSYCTVCCEGRELLLCSN<br>TSCCRCFCVECLEVLVGAGTAEDVKLQEPWSCYMCLPQRCHGVLRRRKDWNMRL<br>QDFFTTDPDLEEFEPPKLYPAIPAAKRRPIRVLSLEDGIATGYLVLKELGIKVE<br>KYIASEVCAESIAVGTVKHEGQIKYVDDIRNITKEHIDEWGPFDLVIGGSPCND<br>LSCVNPVRKGLFEGTGRLFFEFYRLLNYSCPEEEDDRPFFWMFENVVAMEVGDK<br>RDISRFLECNPVMIDAIKVSAAHRARYFWGNLPGMNRPVMASKNDKLELQDCLE<br>FSRTAKLKKVQTITTKSNSIRQGKNQLFPVVMNGKDDVLWCTELERIFGFPEHY<br>TDVSNMGRGARQKLLGRSWSVPVIRHLFAPLKDHFACE |
| 1032 | human DNMT3L | MAAIPALDPEAEPSMDVILVGSSELSSSVSPGTGRDLIAYEVKANQRNIEDICI<br>CCGSLQVHTQHPLFEGGICAPCKDKFLDALFLYDDDGYQSYCSICCSGETLLIC<br>GNPDCTRCYCFECVDSLVGPGTSGKVHAMSNWVCYLCLPSSRSGLLQRRRKWRS<br>QLKAFYDRESENPLEMFETVPVWRRQPVRVLSLFEDIKKELTSLGFLESGSDPG<br>QLKHVVDVTDTVRKDVEEWGPFDLVYGATPPLGHTCDRPPSWYLEQFHRLLQYA<br>RPKPGSPRPFFWMFVDNLVLNKEDLDVASRFLEMEPVTIPDVHGGSLQNAVRVW<br>SNIPAIRSSRHWALVSEEELSLLAQNKQSSKLAAKWPTKLVKNCELPLREYFKY<br>FSTELTSSL |
| 1033 | human DNMT3L catalytic domain | NPLEMFETVPVWRRQPVRVLSLFEDIKKELTSLGFLESGSDPGQLKHVVDVTDT<br>VRKDVEEWGPFDLVYGATPPLGHTCDRPPSWYLFQFHRLLQYARPKPGSPRPFF<br>WMFVDNLVLNKEDLDVASRFLEMEPVTIPDVHGGSLQNAVRVWSNIPAIRSRHW<br>ALVSEEELSLLAQNKQSSKLAAKWPTKLVKNCFLPLREYFKYFSTELTSSL |
| 1034 | mouse DNMT3L | MGSRETPSSCSKTLETLDLETSDSSSPDADSPLEEQWLKSSPALKEDSVDVVLE<br>DCKEPLSPSSPPTGREMIRYEVKVNRRSIEDICLCCGTLQVYTRHPLFEGGLCA<br>PCKDKFLESLFLYDDDGHQSYCTICCSGGTLFICESPDCTRCYCFECVDILVGP<br>GTSERINAMACWVCFLCLPPFSRSGLLQRRKRWRHQLKAFHDQEGAGPMEIYKTV<br>SAWKRQPVRVLSLERNIDKVLKSLGFLESGSGSGGGTLKYVEDVTNVVRRDVEK<br>WGPFDLVYGSTQPLGSSCDRCPGWYMFQFHRILQYALPRQESQRPFFWIEMDNL<br>LLTEDDQETTTRELQTEAVTLQDVRGRDYQNAMRVWSNIPGLKSKHAPLTPKEE<br>EYLQAQVRSRSKLDAPKVDLLVKNCLLPLREYFKYFSQNSLPL |
| 1035 | mouse DNMT3L catalytic domain | GPMEIYKTVSAWKRQPVRVLSLERNIDKVLKSLGFLESGSGSGGGTLKYVEDVT<br>NVVRRDVEKWGPFDLVYGSTQPLGSSCDRCPGWYMFQFHRILQYALPRQESQRP<br>FFWIEMDNLLLTEDDQETTTRFLQTEAVTLQDVRGRDYQNAMRVWSNIPGLKSK<br>HAPLTPKEEEYLQAQVRSRSKLDAPKVDLLVKNCLLPLREYFKYFSQNSLPL |
| 1036 | human TRDMT1 (DNMT2) | MEPLRVLELYSGVGGMHHALRESCIPAQVVAAIDVNTVANEVYKYNFPHTQLLA<br>KTIEGITLEEFDRLSFDMILMSPPCQPFTRIGRQGDMTDSRTNSFLHILDILPR<br>LQKLPKYILLENVKGFEVSSTRDLLIQTIENCGFQYQEFLLSPTSLGIPNSRLR<br>YFLIAKLQSEPLPFQAPGQVLMEFPKIESVHPQKYAMDVENKIQEKNVEPNISE<br>DGSIQCSGKDAILFKLETAEEIHRKNQQDSDLSVKMLKDFLEDDTDVNQYLLPP<br>KSLLRYALLLDIVQPTCRRSVCFTKGYGSYIEGTGSVLQTAEDVQVENIYKSLT<br>NLSQEEQITKLLILKLRYFTPKEIANLLGFPPEFGFPEKITVKQRYRLLGNSLN<br>VHVVAKLIKILYE |

TABLE 18-continued

Sequence listing.

| SEQ | Description | Sequence |
|---|---|---|
| 1037 | M. penetrans M MpeI | MNSNKDKIKVIKVFEAFAGIGSQFKALKNIARSKNWEIQHSGMVEWFVDAIVSY VAIHSKNFNPKIEQLDKDILSISNDSKMPISEYGIKKINNTIKASYLNYAKKHF NNLFDIKKVNKDNFPKNIDIFTYSFPCQDLSVQGLQKGIDKELNTRSGLLWEIE RILEEIKNSFSKEEMPKYLLMENVKNLLSHKNKKNYNTWLKQLEKFGYKSKTYL LNSKNEDNCQNRERVFCLSIRDDYLEKTGFKFKELEKVKNPPKKIKDILVDSSN YKYLNLNKYETTTFRETKSNIISRSLKNYTTENSENYVYNINGIGPTLTASGAN SRIKIETQQGVRYLTPLECFKYMQFDVNDFKKVQSTNLISENKMIYIAGNSIPV KILEAIENTLEFVNNEE |
| 1038 | S. monobiae M SssI | MSKVENKTKKLRVFEAFAGIGAQRKALEKVRKDEYEIVGLAEWYVPAIVMYQAI HNNFHTKLEYKSVSREEMIDYLENKTLSWNSKNPVSNGYWKRKKDDELKIIYNA IKLSEKEGNIFDIRDLYKRTLKNIDLLTYSFPCQDLSQQGIQKGMKRGSGTRSG LLWEIERALDSTEKNDLPKYLLMENVGALLHKKNEEELNQWKQKLESLGYQNSI EVLNAADFGSSQARRRVEMISTLNEFVELPKGDKKPKSIKKVLNKIVSEKDILN NLLKYNLTEFKKTKSNINKASLIGYSKENSEGYVYDPEFTGPTLTASGANSRIK IKDGSNIRKMNSDETFLYIGFDSQDGKRVNEIEFLTENQKIFVCGNSISVEVLE AIIDKIGG |
| 1039 | H. parainfluenzae M HpaII | MKDVLDDNLLEEPAAQYSLFEPESNPNLREKFTFIDLFAGIGGFRIAMQNLGGK CIFSSEWDEQAQKTYEANFGDLPYGDITLEETKAFIPEKFDILCAGEPCQAFSI AGKRGGFEDTRGTLFFDVAEIIRRHQPKAFFLENVKGLKNHDKGRTLKTILNVL REDLGYFVPEPAIVNAKNFGVPQNRERIYIVGFHKSTGVNSESYPEPLDKIVTE ADIREEKTVPTKYYLSTQYIDTLRKHKERHESKGNGFGYEIIPDDGIANAIVVG GMGRERNLVIDHRITDETPTTNIKGEVNREGIRKMTPREWARLQGFPDSYVIPV SDASAYKQFGNSVAVPAIQATGKKILEKLGNLYD |
| 1040 | A. luteus M AluI | MSKANAKYSFVDLFAGIGGFHAALAATGGVCEYAVEIDREAAAVYERNWNKPAL GDITDDANDEGVTLRGYDGPIDVLTGGFPCQPFSKSGAQHGMAETRGTLFWNIA RIIEEREPTVLILENVRNLVGPRHREWLTIIETLRFFGYEVSGAPAIFSPHLL PAWMGGTPQVRERVFITATLVPERMRDERIPRTETGEIDAEAIGPKPVATMNDR FPIKKGGTELFHPGDRKSGWNLLTSGIIREGDPEPSNVDLRLTETETLWIDAWD DLESTIRRATGRPLEGEPYWADSWTDFRELSRLVVIRGFQAPEREVVGDRKRYV ARTDMPEGFVPASVTRPAIDETLPAWKQSHLRRNYDFFERHFAEVVAWAYRWGV YTDLFPASRRKLEWQAQDAPRLWDTVMHFRPSGIRAKRPTYLPALVAITQTSIV GPLERRLSPRETARLQGLPEWFDFGEQRAAATYKQMGNGVNVGVVRHILREHVR RDRALLKLTPAGQRIINAVLADEPDATVGALGAAE |
| 1041 | H. aegyptius M HaeIII | MNLISLESGAGGLDLGFQKAGFRIICANEYDKSIWKTYESNHSAKLIKGDISKI SSDEFPKCDGIIGGPPCQSWSEGGSLRGIDDPRGKLFYEYIRILKQKKPIFFLA ENVKGMMAQRHNKAVQEFIQEEFDNAGYDVHIILLNANDYGVAQDRKRVFYIGER KELNINYLPPIPHLIKPTFKDVIWDLKDNPIPALDKNKTNGNKCIYPNHEYFIG SYSTIFMSRNRVRQWNEPAFTVQASGRQCQLHPQAPVMLKVSKNLNKFVEGKEH LYRRLTVRECARVQGFPDDFIFHYESLNDGYKMIGNAVPVNLAYEIAKTIKSAL EICKGN |
| 1042 | H. haemolyticus M HhaI | MIEIKDKQLTGLRFIDLFAGLGGFRLALESCGAECVYSNEWDKYAQEVYEMNFG EKPEGDITQVNEKTIPDHDILCAGPCQAFSISGKQKGFEDSRGTLFFDIARIV REKKPKVVFMENVKNFASHDNGNTLEVVKNTMNELDYSFHAKVLNALDYGIPQK RERIYMICFRNDLNIQNFQFPKPFELNTFVKDLLLPDSEVEHLVIDRKDLVMTN QEIEQTTPKTVRLGIVGKGGQGERIYSTRGIAITLSAYGGGIFAKTGGYLVNGK TRKLHPRECARVMGYPDSYKVHPSTSQAYKQFGNSVVINVLQYIAYNIGSSLNE KPY |
| 1043 | Moraxella M MspI | MKPEILKLIRSKLDLTQKQASEIIEVSDKTWQQWESGKTEMHPAYYSFLQEKLK DKINFEELSAQKTLQKKIFDKYNQNQITKNAEELAEITHIEERKDAYSSDFKFI DLFSGIGGIRQSFEVNGGKCVESSEIDPFAKFTYYTNFGVVPFGDITKVEATTI PQHDILCAGEPCQPFSHIGKREGFEHPTQGTMFHEIVRIIETKKTPVLFLENVP GLINHDDGNTLKVIIETLEDMGYKVHHTVLDASHFGIPQKRKRFYLVAFLNQNI HFEFPKPPMISKDIGEVLESDVTGYSISEHLQKSYLFKKDDGKPSLIDKNTTGA VKTLVSTYHKIQRLTGTFVKDGETGIRLLTTNECKAIMGFPKDFVIPVSRTQMY RQMGNSVVVPVVTKIAEQISLALKTVNQQSPQENFELELV |
| 1044 | Ascobolus Masc1 | MSERRYEAGMTVALHEGSFLKIQRVYIRQYHADNRREHMLVGPLFRRTKYLKAL SKKVNEVAIVHESIHVPVQDVIGVRELIITNRPFFPECRKGDEHTGRLVCRWVYN LDERAKGREYKKQRYIRRITEAEADPEYRVEDRVLRRRWFQEGYIGDEISYKEH GNGDIVDIRSESPLQVLDGWGGDLVDLENGEETSIPGPCRSASSYGRLMKPPLA QAADSNTSRKYTFGDTFCGGGGVSLGARQAGLEVKWAFDMNPNAGANYRRNEPN TDFFLAEAEQFIQLSVGISQHVDILHLSPPCQTFSRAHTIAGKNDENNEASFFA VVNLIKAVRPRLFTVEETDGIMDRQSRQFIDTALMGITELGYSFRICVLNAIEY GVCQNRKRLIIIGAAPGEELPPPFLPTHQDFFSKDPRRDLLPAVTLDDALSTIT PESTDHHLNHVWQPAEWKTPYDAHRPFKNAIRAGGGEYDIYPDGRRKFTVRELA CIQGFPDEYEFVGTLTDKRRIIGNAVPPPLSAAIMSTLRQWMTEKDFERME |
| 1045 | Arabidopsis MET1 | MVENGAKAAKRKKRPLPEIQEVEDVPRTRRPRRAAACTSFKEKSIRVCEKSATI EVKKQQIVEEEFLALRLTALETDVEDRPTRRLNDFVLEDSDGVPQPLEMLEIHD |

TABLE 18-continued

Sequence listing.

| SEQ | Description | Sequence |
|---|---|---|
| | | IFVSGAILPSDVCTDKEKEKGVRCTSFGRVEHWSISGYEDGSPVIWISTELADY<br>DCRKPAASYRKVYDYFYEKARASVAVYKKLSKSSGGDPDIGLEELLAAVVRSMS<br>SGSKYFSSGAAIIDFVISQGDFIYNQLAGLDETAKKHESSYVEIPVLVALREKS<br>SKIDKPLQRERNPSNGVRIKEVSQVAESEALTSDQLVDLTDDDRRYAILLQDEE<br>NRKSMQQPRKNSSSGSASNMFYIKINEDEIANDYPLPSYYKTSEEETDELILYD<br>ASYEVQSEHLPHRMLHNWALYNSDLRFISLELLPMKQCDDIDVNIFGSGVVTDD<br>NGSWISLNDPDSGSQSHDPDGMCIFLSQIKEWMIEFGSDDIISISIRTDVAWYR<br>LGKPSKLYAPWWKPVLKTARVGISILTFLRVESRVARLSFADVTKRLSGLQAND<br>KAYISSDPLAVERYLVVHGQIILQLFAVYPDDNVKRCPFVVGLASKLEDRHHTK<br>WIIKKKKISLKELNLNPRAGMAPVASKRKAMQATTTRLVNRIWGEFYSNYSPED<br>PLQATAAENGEDEVEEEGGNGEEEVEEEGENGLTEDTVPEPVEVQKPHTPKKIR<br>GSSGKREIKWDGESLGKTSAGEPLYQQALVGGEMVAVGGAVTLEVDDPDEMPAI<br>YFVEYMFESTDHCKMLHGRFLQRGSMTVLGNAANERELFLTNECMTTQLKDIKG<br>VASFEIRSRPWGHQYRKKNITADKLDWARALERKVKDLPTEYYCKSLYSPERGG<br>FFSLPLSDIGRSSGFCTSCKIREDEEKRSTIKLNVSKTGFFINGIEYSVEDEVY<br>VNPDSIGGLKEGSKTSFKSGRNIGLRAYVVCQLLEIVPKESRKADLGSEDVKVR<br>RFYRPEDVSAEKAYASDIQELYFSQDTVVLPPGALEGKCEVRKKSDMPLSREYP<br>ISDHIFFCDLFFDTSKGSLKQLPANMKPKFSTIKDDTLLRKKKGKGVESEIESE<br>IVKPVEPPKEIRLATLDIFAGCGGLSHGLKKAGVSDAKWAIEYEEPAGQAFKQN<br>HPESTVFVDNCNVILRAIMEKGGDQDDCVSTTEANELAAKLTEEQKSTLPLPGQ<br>VDFINGGPPCQGFSGMNRFNQSSWSKVQCEMILAFLSFADYFRPRYFLLENVRT<br>FVSFNKGQTFQLTLASLLEMGYQVRFGILEAGAYGVSQSRKRAFIWAAAPEEVL<br>PEWPEPMHVFGVPKLKISLSQGLHYAAVRSTALGAPFRPITVRDTIGDLPSVEN<br>GDSRTNKEYKEVAVSWFQKEIRGNTIALTDHICKAMNELNLIRCKLIPTRPGAD<br>WHDLPKRKVTLSDGRVEEMIPFCLPNTAERHNGWKGLYGRLDWQGNFPTSVTDP<br>QPMGKVGMCFHPEQHRILTVRECARSQGFPDSYEFAGNINHKHRQIGNAVPPPL<br>AFALGRKLKEALHLKKSPQHQP |
| 1046 | Ascobolus Masc2 | MELTPELSGVSTDLGGGGSIFAHWRMKEESPAPTEILDDLNVLEWEKTTRDYSK<br>EDLRIADQLFSIEDEHQSLPFETADAEDGTPTEEEEEKELPMRTLDNEVLYDAS<br>DLELAALDLIGTELNIHAVGTVGPIYTEGEEDEQEDEDEDVSPPVRTGTQATSA<br>SVTQMTVELYIRNIVQYEFCFNDDGTVETWIQTTNAHYKLLQPAKCYTSLYRPV<br>NDCLNVITAIITLAPESTTMSLKDLLKVMDDKAQAVSYEEVERMSEFIVQHLDQ<br>WMETAPKKKSKLIEKSKVYIDLNNLAGIDMVSGVRPPPVRRVTGRSSAPKKRIV<br>RNMNDAVLLHQNETTVTNWIHQLSAGMFGRALNVLGAETADVENLTCDPASAKF<br>VVPQRRLHKRLKWETRGHIPVSEEEYKHIYQGKKYAKFFEAVRAVDESKLTIKL<br>GDLVYVLDQDPKVTQTQFATAGREGRKKGAEKEKIQVRFGRVLSIRQPDSNSKD<br>AQNVFIHVQWLVLGCDTILQEMASRRELFLTDSCDTVFADVIYGVAKLTPLGAK<br>DIPTVEFHESMATMMGENEFFVRFKYNYQDGSFTDLKDVDAEQIGTLQPRVNTH<br>RNPGYCSNCRIKYDNERTGDKWIYENDTEGEPRLFRSSKGWCIYAQEFVYLQPV<br>EKQPGTTFRVGYISEINKSSVIVELLARVDDDDKSGHISYSDPRHLYFTGTDIK<br>VTFDKIIRKCFVFHDSGDQKAKAPLMYGTLQRDLYYYRYEKRKGKAELVPVREI<br>RSIHEQTLNDWESRTQIERHGAVSGKKLKGLDIFAGCGGLTLGLDLSGAVDTKW<br>DIEFAPSAANTLALNEPDAQVENQCANVLLSRAIQSEDEGSLDIEYDLQGRVLP<br>DLPKKGEVDFIYGGPPCQGFSGVNRYKKGNDIKNSLVATFLSYVDHYKPRFVLL<br>ENVKGLITTKLGNSKNAEGKWEGGISNGVVKFIYRTLISMNYQCRIGLVQSGEY<br>GVPQSRPVIFLAARMGERLPDLPEPMHAFEVLDSQYALPHIKRYHTTQNGVAP<br>LPRITIGEAVSDLPKFQYANPGVWPRHDPYSSAKAQPSDKTIEKFSVSKATSFV<br>GYLLQPYHSRPQSEFQRRLRTKLVPSDEPAEKTSLLTTKLVTAHVTRLENKETT<br>QRIVCVPMWPGADHRSLPKEMRPWCLVDPNSQAEKHRFWPGLFGRLGMEDFEST<br>ALTDVQPCGKQGKVLHPTQRRVYTVRELARAQGFPDWFAFTDGDADSGLGGVKK<br>WHRNIGNAVPVPLGEQIGRCIGYSVWWKDDMIAQLREDGADEDEEMIDGNDQWV<br>EELNTQMAADMPGLPLLVTHLLNLCVYRRLYGPNAKEFLPARVYDKKLEGGRRR<br>LVWAML |
| 1047 | Neurospora Dim2 | MDSPDRSHGGMFIDVPAETMGFQEDYLDMFASVLSQGLAKEGDYAHHQPLPAGK<br>EECLEPIAVATTITPSPDDPQLQLQLELEQQFQTESGLNGVDPAPAPESEDEAD<br>LPDGFSDESPDDDFVVQRSKHITVDLPVSTLINPRSTFQRIDENDNLVPPPQST<br>PERVAVEDLLKAAKAAGKNKEDYIEFELHDENFYVNYAYHPQEMRPIQLVATKV<br>LHDKYYFDGVLKYGNTKHYVTGMQVLELPVGNYGASLHSVKGQIWVRSKHNAKK<br>EIYYLLKKPAFEYQRYYQPFLWIADLGKHVVDYCTRMVERKREVTLGCFKSDFI<br>QWASKAHGKSKAFQNWRAQHPSDDERTSVAANIGYIWKEINGVAGAKRAAGDQL<br>FRELMIVKPGQYFRQEVPPGPVVTEGDRTVAATIVTPYIKECFGHMILGKVLRL<br>AGEDAEKEKEVKLAKRLKIENKNATKADTKDDMKNDTATESLPTPLRSLPVQVL<br>EATPIESDIVSIVSSDLPPSENNPPPLINGSVKPKAKANPKPKPSTQPLHAAHV<br>KYLSQELVNKIKVGDVISTPRDDSSNTDTKWKPTDTDDHRWFGLVQRVHTAKTK<br>SSGRGLNSKSFDVIWFYRPEDTPCCAMKYKWRNELFLSNHCTCQEGHHARVKGN<br>EVLAVHPVDWFGTPESNKGEFFVRQLYESEQRRWITLQKDHLTCYHNQPPKPPT<br>APYKPGDTVLATLSPSDKESDPYEVVEYFTQGEKETAFVRLRKLLRRRKVDRQD<br>APANELVYTEDLVDVRAERIVGKCIMRCFRPDERVPSPYDRGGTGNMFFITHRQ<br>DHGRCVPLDTLPPTLRQGENPLGNLGKPKLRGMDLYCGGGNFGRGLEEGGVVEM<br>RWANDIWDKAIHTYMANTPDDPNKTNPFLGSVDDLLRLALEGKESDNVPRPGEVD<br>FIAAGSPCPGFSLLTQDKKVLNQVKNQSLVASFASFVDFYRPKYGVLENVSGIV<br>QTFVNRKQDVLSQLFCALVGMGYQAQLILGDAWAHGAPQSRERVELYFAAPGLP<br>LPDPPLPSHSYRVKNRNIGFLCNGESYVQRSFIPTAFKFVSAGEGTADLPKIG<br>DGKPDACVRFPDHRLASGITPYIRAQYACIPTHPYGMNFIKAWNNGNGVMSKSD |

TABLE 18-continued

Sequence listing.

| SEQ | Description | Sequence |
|---|---|---|
| | | RDLFPSEGKTRTSDASVGWKRLNPKTLFPTVTTTSNPSDARMGPGLHWDEDRPY TVQEMRRAQGYLDEEVLVGRTTDQWKLVGNSVSRHMALAIGLKFREAWLGTLYD ESAVVATATATATTAAAVGVTVPVMEEPGIGTTESSRPSRSPVHTAVDLDDSKS ERSRSTTPATVLSTSSAAGDGSANAAGLEDDDNDDMEMMEVTRKRSSPAVDEEG MRPSKVQKVEVTVASPASRRSSRQASRNPTASPSSKASKATTHEAPAPEELESD AESYSETYDKEGFDGDYHSGHEDQYSEEDEEEEYAEPETMTVNGMTIVKL |
| 1048 | Drosophila dDnmt2 | MVFRVLELFSGIGGMHYAFNYAQLDGQIVAALDVNTVANAVYAHNYGSNLVKTR NIQSLSVKEVTKLQANMLLMSPPCQPHTRQGLQRDTEDKRSDALTHLCGLIPEC QELEYILMENVKGFESSQARNQFIESLERSGFHWREFILTPTQFNVPNTRYRYY CIARKGADFPFAGGKIWEEMPGAIAQNQGLSQIAEIVEENVSPDFLVPDDVLTK RVLVMDIIHPAQSRSMCFTKGYTHYTEGTGSAYTPLSEDESHRIFELVKEIDTS NQDASKSEKILQQRLDLLHQVRLRYFTPREVARLMSFPENFEFPPETTNRQKYR LLGNSINVKVVGELIKLLTIK |
| 1049 | S. pombe Pmt1 | MLSTKRLRVLELYSGIGGMHYALNLANIPADIVCAIDINPQANEIYNLNHGKLA KHMDISTLTAKDFDAFDCKLWTMSPSCQPFTRIGNRKDILDPRSQAFLNILNVL PHVNNLPEYILIENVQGFEESKAAEECRKVLRNCGYNLIEGILSPNQFNIPNSR SRWYGLARLNEKGEWSIDDVFQFSEVAQKEGEVKRIRDYLEIERDWSSYMVLES VLNKWGHQFDIVKPDSSSCCCFTRGYTHLVQGAGSILQMSDHENTHEQFERNRM ALQLRYFTAREVARLMGFPESLEWSKSNVTEKCMYRLLGNSINVKVVSYLISLL LEPLNE |
| 1050 | Arabidopsis DRM1 | MVMSHIFLISQIQEVEHGDSDDVNWNTDDDELAIDNFQFSPSPVHISATSPNSI QNRISDETVASFVEMGESTQMIARAIEETAGANMEPMMILETLENYSASTEASS SKSKVINHFIAMGFPEEHVIKAMQEHGDEDVGEITNALLTYAEVDKLRESEDMN ININDDDDDNLYSLSSDDEEDELNNSSNEDRILQALIKMGYLREDAAIAIERCG EDASMEEVVDFICAAQMARQFDEIYAEPDKKELMNNNKKRRTYTETPRKPNTDQ LISLPKEMIGFGVPNHPGLMMHRPVPIPDIARGPPFFYYENVAMTPKGVWAKIS SHLYDIVPEFVDSKHFCAAARKRGYIHNLPIQNRFQIQPPQHNTIQEAFPLTKR WWPSWDGRTKLNCLLTCIASSRLTEKIREALERYDGETPLDVQKWVMYECKKWN LVWVGKNKLAPLDADEMEKLLGFPRDHTRGGGISTTDRYKSLGNSFQVDTVAYH LSVLKPLFPNGINVLSLFTGIGGGEVALHRLQIKMNVVVSVEISDANRNILRSF WEQTNQKGILREFKDVQKLDDNTIERLMDEYGGFDLVIGGSPCNNLAGGNRHHR VGLGGEHSSLFFDYCRILEAVRRKARHMRR |
| 1051 | Arabadopsis DRM2 | MVIWNNDDDDFLEIDNFQSSPRSSPIHAMQCRVENLAGVAVTTSSLSSPTETTD LVQMGFSDEVFATLEDMGFPVEMISRAIKETGPNVETSVIIDTISKYSSDCEAG SSKSKAIDHELAMGFDEEKVVKAIQEHGEDNMEAIANALLSCPEAKKLPAAVEE EDGIDWSSSDDDTNYTDMLNSDDEKDPNSNENGSKIRSLVKMGESELEASLAVE RCGENVDIAELTDELCAAQMAREFSEFYTEHEEQKPRHNIKKRRFESKGEPRSS VDDEPIRLPNPMIGFGVPNEPGLITHRSLPELARGPPFFYYENVALTPKGVWET ISRHLFEIPPEFVDSKYFCVAARKRGYIHNLPINNRFQIQPPPKYTIHDAFPLS KRWWPEWDKRTKLNCILTCTGSAQLTNRIRVALEPYNEEPEPPKHVQRYVIDQC KKWNLVWVGKNKAAPLEPDEMESILGFPKNHTRGGGMSRTERFKSIGNSFQVDT VAYHLSVLKPIFPHGINVLSLFTGIGGGEVALHRLQIKMKLVVSVEISKVNRNI LKDFWEQTNQTGELIEFSDIQHLTNDTIEGLMEKYGGEDLVIGGSPCNNLAGGN RVSRVGLEGDQSSLFFEYCRILEVVRARMRGS |
| 1052 | Arabadopsis CMT1 | MAARNKQKKRAEPESDLCFAGKPMSVVESTIRWPHRYQSKKTKLQAPTKKPANK GGKKEDEEIIKQAKCHFDKALVDGVLINLNDDVYVTGLPGKLKFIAKVIELFEA DDGVPYCRERWYYRPEDTLIERFSHLVQPKRVFLSNDENDNPLTCIWSKVNIAK VPLPKITSRIEQRVIPPCDYYYDMKYEVPYLNFTSADDGSDASSSLSSDSALNC FENLHKDEKELLDLYSGCGAMSTGFCMGASISGVKLITKWSVDINKFACDSLKL NHPETEVRNEAAEDELALLKEWKRLCEKESLVSSTEPVESISELEDEEVEENDD IDEASTGAELEPGEFEVEKFLGIMFGDPQGTGEKTLQLMVRWKGYNSSYDTWEP YSGLGNCKEKLKEYVIDGFKSHLLPLPGTVYTVCGGPPCQGISGYNRYRNNEAP LEDQKNQQLLVELDIIDELKPNYVLMENVVDLLRESKGFLARHAVASFVAMNYQ TRLGMMAAGSYGLPQLRNRVFLWAAQPSEKLPPYPLPTHEVAKKENTPKEFKDL QVGRIQMEFLKLDNALTLADAISDLPPVTNYVANDVMDYNDAAPKTEFENFISL KRSETLLPAFGGDPTRRLEDHQPLVLGDDDLERVSYIPKQKGANYRDMPGVLVH NNKAEINPRFRAKLKSGKNVVPAYAISFIKGKSKKPFGRLWGDEIVNTVVTRAE PHNQCVIHPMQNRVLSVRENARLQGFPDCYKLCGTIKEKYIQVGNAVAVPVGVA LGYAFGMASQGLTDDEPVIKLPFKYPECMQAKDQI |
| 1053 | Arabadopsis CMT2 | MLSPAKCESEEAQAPLDLHSSSRSEPECLSLVLWCPNPEEAAPSSTRELIKLPD NGEMSLRRSTTLNCNSPEENGGEGRVSQRKSSRGKSQPLLMLTNGCQLRRSPRF RALHANFDNVCSVPVTKGGVSQRKFSRGKSQPLLTLTNGCQLRRSPRFRAVDGN FDSVCSVPVTGKFGSRKRKSNSALDKKESSDSEGLTFKDIAVIAKSLEMEIISE CQYKNNVAEGRSRLQDPAKRKVDSDTLLYSSINSSKQSLGSNKRMRRSQREMKG TENEGEENLGKSKGKGMSLASCSFRRSTRLSGTVETGNTETLNRRKDCGPALCG AEQVRGTERLVQISKKDHCCEAMKKCEGDGLVSSKQELLVFPSGCIKKTVNGCR DRTLGKPRSSGLNTDDIHTSSLKISKNDTSNGLTMTTALVEQDAMESLLQGKTS ACGAADKGKTREMHVNSTVIYLSDSDEPSSIEYLNGDNLTQVESGSALSSGGNE GIVSLDLNNPTKSTKRKGKRVTRTAVQEQNKRSICFFIGEPLSCEEAQERWRWR YELKERKSKSRGQQSEDDEDKIVANVECHYSQAKVDGHTFSLGDFAYIKGEEEE |

TABLE 18-continued

Sequence listing.

| SEQ | Description | Sequence |
|---|---|---|
| | | THVGQIVEFFKTTDGESYFRVQWFYRATDTIMERQATNHDKRRLFYSTVMNDNP<br>VDCLISKVTVLQVSPRVGLKPNSIKSDYYFDMEYCVEYSTFQTLRNPKTSENKL<br>ECCADVVPTESTESILKKKSFSGELPVLDLYSGCGGMSTGLSLGAKISGVDVVT<br>KWAVDQNTAACKSLKLNHPNTQVRNDAAGDFLQLLKEWDKLCKRYVENNDQRTD<br>TLRSVNSTKETSGSSSSSDDDSDSEEYEVEKLVDICFGDHDKTGKNGLKFKVHW<br>KGYRSDEDTWELAEEELSNCQDAIREFVTSGFKSKILPLPGRVGVICGGPPCQGI<br>SGYNRHRNVDSPLNDERNQQIIVEMDIVEYLKPSYVLMENVVDILRMDKGSLGR<br>YALSRLVNMRYQARLGIMTAGCYGLSQFRSRVEMWGAVPNKNLPPFPLPTHDVI<br>VRYGLPLEFERNVVAYAEGQPRKLEKALVLKDAISDLPHVSNDEDREKLPYESL<br>PKTDFQRYIRSTKRDLTGSAIDNCNKRTMLLHDHRPFHINEDDYARVCQIPKRK<br>GANFRDLPGLIVRNNTVCRDPSMEPVILPSGKPLVPGYVFTFQQGKSKRPEARL<br>WWDETVPTVLTVPTCHSQALLHPEQDRVLTIRESARLQGFPDYFQFCGTIKERY<br>CQIGNAVAVSVSRALGYSLGMAFRGLARDEHLIKLPQNFSHSTYPQLQETIPH |
| 1054 | Arabadopsis CMT3 | MAPKRKRPATKDDTTKSIPKPKKRAPKRAKTVKEEPVTVVEEGEKHVARELDEP<br>IPESEAKSTWPDRYKPIEVQPPKASSRKKTKDDEKVEIIRARCHYRRAIVDERQ<br>IYELNDDAYVQSGEGKDPFICKIIEMFEGANGKLYFTARWFYRPSDTVMKEFEI<br>LIKKKRVFFSEIQDTNELGLLEKKLNILMIPLNENTKETIPATENCDFFCDMNY<br>FLPYDTFEAIQQETMMAISESSTISSDTDIREGAAAISEIGECSQETEGHKKAT<br>LLDLYSGCGAMSTGLCMGAQLSGLNLVTKWAVDMNAHACKSLQHNHPETNVRNM<br>TAEDFLFLLKEWEKLCIHFSLRNSPNSEEYANLHGLNNVEDNEDVSEESENEDD<br>GEVFTVDKIVGISFGVPKKLLKRGLYLKVRWLNYDDSHDTWEPIEGLSNCRGKI<br>EEFVKLGYKSGILPLPGGVDVVCGGPPCQGISGHNRERNLLDPLEDQKNKQLLV<br>YMNIVEYLKPKFVLMENVVDMLKMAKGYLARFAVGRLLQMNYQVRNGMMAAGAY<br>GLAQFRLRFFLWGALPSEIIPQFPLPTHDLVHRGNIVKEFQGNIVAYDEGHTVK<br>LADKLLLKDVISDLPAVANSEKRDEITYDKDPTTPFQKFIRLRKDEASGSQSKS<br>KSKKHVLYDHHPLNLNINDYERVCQVPKRKGANFRDEPGVIVGPGNVVKLEEGK<br>ERVKLESGKTLVPDYALTYVDGKSCKPFGRLWWDEIVPTVVTRAEPHNQVIIHP<br>EQNRVLSIRENARLQGFPDDYKLFGPPKQKYIQVGNAVAVPVAKALGYALGTAF<br>QGLAVGKDPLLTLPEGFAFMKPTLPSELA |
| 1055 | Neurospora Rid | MAEQNPFVIDDEDDVIQIHDEEEVEEEVAEVIDITEDDIEPSELDRAFGSRPKE<br>ETLPSLLLRDQGFIVRPGMTVELKAPIGRFAISFVRVNSIVKVRQAHVNNVTIR<br>GHGFTRAKEMNGMLPKQLNECCLVASIDTRDPRP |
| 1056 | E. coli strain 12 hsdM | MNNNDLVAKLWKLCDNLRDGGVSYQNYVNELASLLFLKMCKETGQEAEYLPEGY<br>RWDDLKSRIGQEQLQFYRKMLVHLGEDDKKLVQAVFHNVSTTITEPKQITALVS<br>NMDSLDWYNGAHGKSRDDFGDMYEGLLQKNANETKSGAGQYFTPRPLIKTIIHL<br>LKPQPREVVQDPAAGTAGFLIEADRYVKSQTNDLDDLDGDTQDFQIHRAFIGLE<br>LVPGTRRLALMNCLLHDIEGNLDHGGAIRLGNTLGSDGENLPKAHIVATNPPFG<br>SAAGTNITRTFVHPTSNKQLCFMQHIIETLHPGGRAAVVVPDNVLFEGGKGTDI<br>RRDLMDKCHLHTILRLPTGIFYAQGVKTNVLFFTKGTVANPNQDKNCTDDVWVY<br>DLRTNMPSFGKRTPFTDEHLQPFERVYGEDPHGLSPRTEGEWSENAEETEVADS<br>EENKNTDQHLATSRWRKFSREWIRTAKSDSLDISWLKDKDSIDADSLPEPDVLA<br>AEAMGELVQALSELDALMRELGASDEADLQRQLLEEAFGGVKE |
| 1057 | E. coli strain 12 hsdS | MSAGKLPEGWVIAPVSTVTTLIRGVTYKKEQAINYLKDDYLPLIRANNIQNGKE<br>DTTDLVFVPKNLVKESQKISPEDIVIAMSSGSKSVVGKSAHQHLPFECSEGAFC<br>GVLRPEKLIFSGFIAHFTKSSLYRNKISSLSAGANINNIKPASFDLINIPIPPL<br>AEQKIIAEKLDTLLAQVDSTKARFEQIPQILKRERQAVLGGAVNGKLTEKWRNF<br>EPQHSVEKKLNFESILTELRNGLSSKPNESGVGHPILRISSVRAGHVDQNDIRE<br>LECSESESELNRHKLQDGDLLFTRYNGSLEFVGVCGLLKKLQHQNLLYPDKLIRAR<br>LTKDALPEYIEIFFSSPSARNAMMNCVKTTSGQKGISGKDIKSQVVLLPPVKEQ<br>AEIVRRVEQLFAYADTIEKQVNNALARVNNLTQSILAKAFRGELTAQWRAENPD<br>LISGENSAAALLEKIKAERAASGGKKASRKKS |
| 1058 | T. aquaticus M TaqI | MGLPPLLSLPSNSAPRSLGRVETPPEVVDEMVSLAEAPRGGRVLEPACAHGPEL<br>RAFREAHGTAYRFVGVEIDPKALDLPPWAEGILADELLWEPGEAFDLILGNPPY<br>GIVGEASKYPIHVFKAVKDLYKKAFSTWKGKYNLYGAFLEKAVRLLKPGGVLVE<br>VVPATWLVLEDFALLREFLAREGKTSVYYLGEVFPQKKVSAVVIRFQKSGKGLS<br>LWDTQESESGFTPILWAEYPHWEGEIIRFETEETRKLEISGMPLGDLFHIRFAA<br>RSPEFKKHPAVRKEPGPGLVPVLTGRNLKPGWVDYEKNHSGLWMPKERAKELRD<br>FYATPHLVVAHTKGTRVVAAWDERAYPWREEFHLLPKEGVRLDPSSLVQWLNSE<br>AMQKHVRTLYRDFVPHLTLRMLERLPVRREYGEHTSPESARNE |
| 1059 | E. coli M EcoDam | MKKNRAFLKWAGGKYPLLDDIKRHLPKGECLVEPFVGAGSVELNTDESRYILAD<br>INSDLISLYNIVKMRTDEYVQAARELFVPETNCAEVYYQFREEENKSQDPERRA<br>VLFLYLNRYGYNGLCRYNLRGEFNVPFGRYKKPYFPEAELYHFAEKAQNAFFYC<br>ESYADSMARADDASVVYCDPPYAPLSATANFTAYHTNSFTLEQQAHLAEIAEGL<br>VERHIPVLISNHDTMLTREWYQRAKLHVVKVRRSISSNGGTRKKVDELLALYKP<br>GVVSPAKK |
| 1060 | C. crescentus M CcrMI | MKFGPETIIHGDCIEQMNALPEKSVDLIFADPPYNLQLGGDLLRPDNSKVDAVD<br>DHWDQFESFAAYDKFTREWLKAARRVLKDDGAIWVIGSYHNIFRVGVAVQDLGE<br>WILNDIVWRKSNPMPNEKGTRFANAHETLIWASKSQNAKRYTENYDALKMANDE<br>VQMRSDWTIPLCTGEERIKGADGQKAHPTQKPEALLYRVILSTTKPGDVILDPF |

TABLE 18-continued

Sequence listing.

| SEQ | Description | Sequence |
|---|---|---|
| | | FGVGTTGAAAKRLGRKFIGIEREAEYLEHAKARIAKVVPIAPEDLDVMGSKRAE PRVPFGTIVEAGLLSPGDTLYCSKGTHVAKVRPDGSITVGDLSGSIHKIGALVQ SAPACNGWTYWHFKTDAGLAPIDVLRAQVRAGMN |
| 1061 | *C. difficile* CamA | MDDISQDNFLLSKEYENSLDVDTKKASGIYYTPKIIVDYIVKKTLKNHDIIKNP YPRILDISCGCGNFLLEVYDILYDLFEENIYELKKKYDENYWTVDNIHRHILNY CIYGADIDEKAISILKDSLTNKKVVNDLDESDIKINLFCCDSLKKKWRYKEDYI VGNPPYIGHKKLEKKYKKFLLEKYSEVYKDKADLYFCFYKKIIDILKQGGIGSV ITPRYFLESLSGKDLREYIKSNVNVQEIVDELGANIFKNIGVSSCILTFDKKKT KETYIDVFKIKNEDICINKFETLEELLKSSKFEHFNINQRLLSDEWILVNKDDE TFYNKIQEKCKYSLEDIAISFQGIITGCDKAFILSKDDVKLNLVDDKELKCWIK SKNINKYIVDKSEYRLIYSNDIDNENTNKRILDEIIGLYKTKLENRRECKSGIR KWYELQWGREKLFFERKKIMYPYKSNENRFAIDYDNNESSADVYSFFIKEEYLD KFSYEYLVGILNSSVYDKYFKITAKKMSKNIYDYYPNKVMKIRIFRDNNYEEIE NLSKQIISILLNKSIDKGKVEKLQIKMDNLIMDSLGI |
| 1062 | KAP1 | MAASAAAASAAAASAASGSPGPGEGSAGGEKRSTAPSAAASASASAAASSPAGG GAEALELLEHCGVCRERLRPEREPRLLPCLHSACSACLGPAAPAAANSSGDGGA AGDGTVVDCPVCKQQCFSKDIVENYFMRDSGSKAATDAQDANQCCTSCEDNAPA TSYCVECSEPLCETCVEAHQRVKYTKDHTVRSTGPAKSRDGERTVYCNVHKHEP LVLFCESCDTLTCRDCQLNAHKDHQYQFLEDAVRNQRKLLASLVKRLGDKHATL QKSTKEVRSSIRQVSDVQKRVQVDVKMAILQIMKELNKRGRVLVNDAQKVTEGQ QERLERQHWTMTKIQKHQEHILRFASWALESDNNTALLLSKKLIYFQLHRALKM IVDPVEPHGEMKFQWDLNAWTKSAEAFGKIVAERPGTNSTGPAPMAPPRAPGPL SKQGSGSSQPMEVQEGYGFGSGDDPYSSAEPHVSGVKRSRSGEGEVSGLMRKVP RVSLERLDLDLTADSQPPVFKVFPGSTTEDYNLIVIERGAAAAATGQPGTAPAG TPGAPPLAGMAIVKEEETEAAIGAPPTATEGPETKPVLMALAEGPGAEGPRLAS PSGSTSSGLEVVAPEGTSAPGGGPGTLDDSATICRVCQKPGDLVMCNQCEFCFH LDCHLPALQDVPGEEWSCSLCHVLPDLKEEDGSLSLDGADSTGVVAKLSPANQR KCERVLLALFCHEPCRPLHQLATDSTFSLDQPGGTLDLTLIRARLQEKLSPPYS SPQEFAQDVGRMFKQFNKLTEDKADVQSIIGLQRFFETRMNEAFGDTKFSAVLV EPPPMSLPGAGLSSQELSGGPGDGP |
| 1063 | MECP2 | MVAGMLGLREEKSEDQDLQGLKDKPLKFKKVKKDKKEEKEGKHEPVQPSAHHSA EPAEAGKAETSEGSGSAPAVPEASASPKQRRSIIRDRGPMYDDPTLPEGWTRKL KQRKSGRSAGKYDVYLINPQGKAFRSKVELIAYFEKVGDTSLDPNDEDFTVTGR GSPSRREQKPPKKPKSPKAPGTGRGRGRPKGSGTTRPKAATSEGVQVKRVLEKS PGKLLVKMPFQTSPGGKAEGGGATTSTQVMVIKRPGRKRKAEADPQAIPKKRGR KPGSVVAAAAAEAKKKAVKESSIRSVQETVLPIKKRKTRETVSIEVKEVVKPLL VSTLGEKSGKGLKTCKSPGRKSKESSPKGRSSSASSPPKKEHHHHHHSESPKA PVPLLPPLPPPPEPESSEDPTSPPEPQDLSSSVCKEEKMPRGGSLESDGCPKE PAKTQPAVATAATAAEKYKHRGEGERKDIVSSSMPRPNREEPVDSRTPVTERVS |
| 1064 | linker | SGSETPGTSESATPES |
| 1065 | linker | SGGS |
| 1066 | linker | SGGSSGSETPGTSESATPESSGGS |
| 1067 | linker | SGGSSGGSSGSETPGTSESATPESSGGSSGGS |
| 1068 | linker | GGSGGSPGSPAGSPTSTEEGTSESATPESGPGTSTEPSEGSAPGSPAGSPTSTE EGTSTEPSEGSAPGTSTEPSEGSAPGTSESATPESGPGSEPATSGGSGGS |
| 1069 | XTEN linker (XTEN16) | SGSETPGTSESATPES |
| 1070 | XTEN linker | SGGSSGGSSGSETPGTSESATPES |
| 1071 | XTEN linker | SGGSSGGSSGSETPGTSESATPESSGGSSGGSSGGSSGGS |
| 1072 | XTEN linker | SGGSSGGSSGSETPGTSESATPESSGGSSGGSSGGSSGGSSGSETPGTSESATP ESSGGSSGGS |
| 1073 | XTEN linker | PGSPAGSPTSTEEGTSESATPESGPGTSTEPSEGSAPGSPAGSPTSTEEGTSTE PSEGSAPGTSTEPSEGSAPGTSESATPESGPGSEPATS |
| 1074 | NLS | PKKKRKV |
| 1075 | NLS | AVKRPAATKKAGQAKKKKLD |
| 1076 | NLS | MSRRRKANPTKLSENAKKLAKEVEN |
| 1077 | NLS | PAAKRVKLD |
| 1078 | NLS | KLKIKRPVK |

TABLE 18-continued

Sequence listing.

| SEQ | Description | Sequence |
|---|---|---|
| 1079 | NLS | MDSLLMNRRKFLYQFKNVRWAKGRRETYLC |
| 1092 | XTEN linker (XTEN80) | GGPSSGAPPPSGGSPAGSPTSTEEGTSESATPESGPGTSTEPSEGSAPGSPAGS PTSTEEGTSTEPSEGSAPGTSTEPSE |
| 1236 | Plasmid for fusion protein with mRNA001 | CGTCGATCGACGGATCGGGAGATCTCCCGATCCCCTATGGTGCACTCTCAGTAC AATCTGCTCTGATGCCGCATAGTTAAGCCAGTATCTGCTCCCTGCTTGTGTGTT GGAGGTCGCTGAGTAGTGCGCGAGCAAAATTTAAGCTACAACAAGGCAAGGCTT GACCGACAATTGCATGAAGAATCTGCTTAGGGTTAGGCGTTTTGCGCTGCTTCG CGATGTACGGGCCAGATATACGCGTTGACATTGATTATTGACTAGTTATTAATA GTAATCAATTACGGGGTCATTAGTTCATAGCCCATATATGGAGTTCCGCGTTAC ATAACTTACGGTAAATGGCCCGCCTGGCTGACCGCCCAACGACCCCCGCCCATT GACGTCAATAATGACGTATGTTCCCATAGTAACGCCAATAGGGACTTTCCATTG ACGTCAATGGGTGGAGTATTTACGGTAAACTGCCCACTTGGCAGTACATCAAGT GTATCATATGCCAAGTACGCCCCCTATTGACGTCAATGACGGTAAATGGCCCGC CTGGCATTATGCCCAGTACATGACCTTATGGGACTTTCCTACTTGGCAGTACAT CTACGTATTAGTCATCGCTATTACCATGGTGATGCGGTTTTGGCAGTACATCAA TGGGCGTGGATAGCGGTTTGACTCACGGGGATTTCCAAGTCTCCACCCCATTGA CGTCAATGGGAGTTTGTTTTGGCACCAAAATCAACGGGACTTTCCAAAATGTCG TAACAACTCCGCCCCATTGACGCAAATGGGCGGTAGGCGTGTACGGTGGGAGGT CTATATAAGCAGAGCTCTCTGGCTAACTAGAGAACCCACTGCTTACTGGCTTAT CGAAATTAATACGACTCACTATAAGGAGACCCAAGCTACCGGTGCCACCATGTA CCCATACGATGTTCCAGATTACGCTTCGCCGAAGAAAAAGCGCAAGGTCAATCA CGATCAGGAGTTCGACCCCCCTAAGGTGTACCCACCAGTGCCTGCAGAGAAGAG GAAGCCAATCCGGGTGCTGAGCCTGTTTGATGGCATCGCCACCGGCCTGCTGGT GCTGAAGGATCTGGGCATCCAGGTGGACCGGTACATCGCCTCCGAGGTGTGCGA GGATTCTATCACCGTGGGCATGGTGCGCCACCAGGGCAAGATCATGTATGTGGG CGACGTGCGGTCCGTGACACAGAAGCACATCCAGGAGTGGGGCCCATTCGATCT GGTGATCGGCGGCAGCCCCTGTAATGACCTGTCCATCGTGAACCCTGCAAGGAA GGGACTGTACGAGGGAACCGGCCGGCTGTTCTTTGAGTTTTATAGACTGCTGCA CGACGCCAGGCCTAAGGAGGGCGACGATAGACCATTCTTTTGGCTGTTCGAGAA TGTGGTGGCTATGGGCGTGAGCGATAAGAGGGACATCTCCAGGTTTCTGGAGTC TAACCCCGTGATGATCGATGCAAAGGAGGTGTCCGCCGCACACAGAGCCAGGTA TTTCTGGGGCAATCTGCCCAGGAATGAACAGGCCACTGGCAAGCACCGTGAATGA CAAGCTGGAGCTGCAGGAGTGCCTGGAGCACGGAAGGATCGCCAAGTTTTCCAA GGTGCGCACAATCACCACACGGAGCAATTCCATCAAGCAGGGCAAGGATCAGCA CTTCCCCGTGTTCATGAACGAGAAGGAGGACATCCTGTGGTGTACGAGATGGA GAGAGTGTTCGGCTTTCCAGTGCACTACACAGACGTGTCTAACATGAGCAGGCT GGCAAGGCAGCGGCTGCTGGGCAGATCTTGGAGCGTGCCCGTGATCAGGCACCT GTTCGCCCCTCTGAAGGAGTATTTTGCCTGCGTGAGCAGCGGCAACTCCAATGC CAACAGCCGGGGCCCCTCTTTCAGCTCCGGATTGGTGCCTCTGAGCCTGAGGGG CTCCCACATGGCAGCAATCCCCGCCCTGGACCCCGAGGCCGAGCCTAGCATGGA CGTGATCCTGGTGGGCTCTAGCGAGCTGTCCTCTAGCGTGTCTCCAGGAACCGG AAGGGATCTGATCGCATACGAGGTGAAGGCCAATCAGCGGAACATCGAGGACAT CTGTATCTGCTGTGGCAGCCTGCAGGTGCACACACAGCACCCACTGTTCGAGGG AGGAATCTGCGCACCCTGTAAGGATAAGTTCCTGGACGCCCTGTTTCTGTACGA CGATGACGGCTACCAGTCCTATTGCTCTATCTGCTGTTCCGGCGAGACCCTGCT GATCTGCGGCAATCCAGATTGTACAAGGTGCTATTGTTTTGAGTGCGTGGACTC TCTGGTGGGACCAGGCACCAGCGGAAAGGTGCACGCCATGTCCAACTGGGTGTG CTACCTGTGCCTGCCATCCTCTCGCAGCGGACTGCTGCAGCGGAGAAGGAAGTG GAGATCCCAGCTGAAGGCCTTCTATGATAGGGAGTCTGAGAACCCCCTGGAGAT GTTTGAGACCGTGCCAGTGTGGCGCCGGCAGCCCGTGAGGGTGCTGAGCCTGTT CGAGGATATCAAGAAGGAGCTGACATCCCTGGGCTTTCTGGAGTCCGGCTCTGA CCCCGGACAGCTGAAGCACGTGGTGGATGTGACCGACACAGTGCGGAAGGATGT GGAGGAGTGGGGCCCTTTCGACCTGGTGTACGGAGCAACCCCTCCACTGGGACA CACATGCGACAGACCCCCTTCTTGGTACCTGTTCCAGTTTCACCGCCTGCTGCA GTATGCAAGGCCAAAGCCAGGCAGCCCTAGACCATTCTTTTGGATGTTCGTGGA TAATCTGGTGCTGAACAAGGAGGATCTGGACGTGGCCAGCAGGTTTCTGGAGAT GGAGCCAGTGACCATCCCAGACGTGCACGGCGGCTCCCTGCAGAATGCCGTGCG CGTGTGGTCTAACATCCCTGCCATCAGAAGCAGGCACTGGGCACTGGTGAGCGA GGAGGAGCTGTCCCTGCTGGCCCAGAATAAGCAGAGCAGCAAGCTGGCCGCCAA GTGGCCTACAAAGCTGGTGAAGAACTGCTTCCTGCCACTGCGGGAGTACTTCAA GTATTTTTCCACCGAGCTGACATCTAGCCTGGGAGGACCCTCCTCTGGCGCCCC ACCACCTAGCGGCGCTCCCCTGCCGGCTCTCCAACCAGCACAGAGGAGGGCAC CAGCGAGTCCGCCACACCAGAGTCTGGACCTGGCACCAGCACAGAGCCATCCGA GGGCTCTGCCCCAGGCTCTCCTGCAGGCAGCCCTACCTCCACCGAAGAGGGCAC CAGCACAGAGCCTTCTGAGGGCAGCGCCCCAGGCACCTCTACAGAGCCAAGCGA GCTCGAGTCCCGGCCAGGGGAACGGCCCTTCCAGTGTCGGATCTGCATGAGAAA CTTTTCAAAGAAGTTCAATCTCCTTCAGCATACCCGGACCCACACTGGAGAGAA ACCCTTTCAGTGCAGGATATGTATGCGGAATTTTTCCCGGCAAGATAATTTGAA TTCCCATTTGAGAACACATACCGGGAGTCAGAAGCCTTTCCAATGCCGGATTTG CATGAGGAACTTCTCCCGAAGCCATAATTTGAAACTCCATACTAGAACACATAC AGGCGAGAAGCCATTCCAGTGTAGGATCTGCATGCGCAATTTTAGCCAATCAAC CACTCTTAAACGCCATCTGAGAACGCATACAGGTAGTCAGAAGCCTTTTCAGTG CAGGATCTGCATGAGGAATTTTAGTCGCAACACGAACTTGACTAGACACACAAG |

TABLE 18-continued

Sequence listing.

| SEQ | Description | Sequence |
|---|---|---|
|  |  | AACGCATACTGGAGAGAAGCCCTTTCAGTGTAGGATTTGTATGCGGAACTTCAG<br>CATTAAACACAACCTGGCAAGGCATCTGAGGACTCATTTGCGCGGGTCTAGCCC<br>CAAGAAGAAGAGAAAGGTGGGAGTCGACGGATCCAGCGGCTCCGAGACCCCAGG<br>CACATCTGAGAGCGCCACCCCTGAGTCCCGGACCCTGGTGACATTCAAGGACGT<br>GTTCGTGGACTTCACCCGGGAGGAGTGGAAGCTGCTGGACACAGCCCAGCAGAT<br>CGTGTACAGGAACGTGATGCTGGAGAACTATAAGAATCTGGTGTCTCTGGGCTA<br>CCAGCTGACAAAGCCAGATGTGATCCTGCGGCTGGAGAAGGGAGAGGAGCCCTG<br>GCTGGTGTAGTCTAGAAATCAACCTCTGGATTACAAAATTTGTGAAAGATTGAC<br>TGGTATTCTTAACTATGTTGCTCCTTTTACGCTATGTGGATACGCTGCTTTAAT<br>GCCTTTGTATCATGCTATTGCTTCCCGTATGGCTTTCATTTTCTCCTCCTTGTA<br>TAAATCCTGGTTGCTGTCTCTTTATGAGGAGTTGTGGCCCGTTGTCAGGCAACG<br>TGGCGTGGTGTGCACTGTGTTTGCTGACGCAACCCCCACTGGTTGGGGCATTGC<br>CACCACCTGTCAGCTCCTTTCCGGGACTTTTCGCTTTCCCCCTCCCTATTGCCAC<br>GGCGGAACTCATCGCCGCCTGCCTTGCCCGCTGCTGGACAGGGGCTCGGCTGTT<br>GGGCACTGACAATTCCGTGGTGTTGTCGGGGAAATCATCGTCCTTTCCTTGGCT<br>GCTCGCCTGTGTTGCCACCTGGATTCTGCGCGGGACGTCCTTCTGCTACGTCCC<br>TTCGGCCCTCAATCCAGCGGACCTTCCTTCCCGCGGCCTGCTGCCGGCTCTGCG<br>GCCTCTTCCGCGTCTTCGCCTTCGCCCTCAGACGAGTCGGATCTCCCTTTGGGC<br>CGCCTCCCCGCCTGTTAATTAAAAAAAAAAAAAAAAAAAAAAAAAAAAAAAAAA<br>AAAAAAAAAAAAAAAAACTAGTGGCGCCTGATGCGGTATTTTCTCCTTACGCA<br>TCTGTGCGGTATTTCACACCGCATAATCCAGCACAGTGGCGGCCCGTTTAAACC<br>CGCTGATCAGCCTCGACTGTGCCTTCTAGTTGCCAGCCATCTGTTGTTTGCCCC<br>TCCCCCGTGCCTTCCTTGACCCTGGAAGGTGCCACTCCCACTGTCCTTTCCTAA<br>TAAAATGAGGAAATTGCATCGCATTGTCTGAGTAGGTGTCATTCTATTCTGGGG<br>GGTGGGGTGGGGCAGGACAGCAAGGGGGAGGATTGGGAAGACAATAGCAGGCAT<br>GCTGGGGATGCGGTGGGCTCTATGGCTTCTGAGGCGGAAAGAACCAGCTGCATT<br>AATGAATCGGCCAACGCGCGGGGAGAGGCGGTTTGCGTATTGGGCGCTCTTCCG<br>CTTCCTCGCTCACTGACTCGCTGCGCTCGGTCGTTCGGCTGCGGCGAGCGGTAT<br>CAGCTCACTCAAAGGCGGTAATACGGTTATCCACAGAATCAGGGGATAACGCAG<br>GAAAGAACATGTGAGCAAAAGGCCAGCAAAAGGCCAGGAACCGTAAAAAGGCCG<br>CGTTGCTGGCGTTTTTCCATAGGCTCCGCCCCCTGACGAGCATCACAAAAATC<br>GACGCTCAAGTCAGAGGTGGCGAAACCCGACAGGACTATAAAGATACCAGGCGT<br>TTCCCCCTGGAAGCTCCCTCGTGCGCTCTCCTGTTCCGACCCTGCCGCTTACCG<br>GATACCTGTCCGCCTTTCTCCCTTCGGGAAGCGTGGCGCTTTCTCATAGCTCAC<br>GCTGTAGGTATCTCAGTTCGGTGTAGGTCGTTCGCTCCAAGCTGGGCTGTGTGC<br>ACGAACCCCCCGTTCAGCCCGACCGCTGCGCCTTATCCGGTAACTATCGTCTTG<br>AGTCCAACCCGGTAAGACACGACTTATCGCCACTGGCAGCAGCCACTGGTAACA<br>GGATTAGCAGAGCGAGGTATGTAGGCGGTGCTACAGAGTTCTTGAAGTGGTGGC<br>CTAACTACGGCTACACTAGAAGAACAGTATTTGGTATCTGCGCTCTGCTGAAGC<br>CAGTTACCTTCGGAAAAAGAGTTGGTAGCTCTTGATCCGGCAAACAAACCACCG<br>CTGGTAGCGGTTTTTTTGTTTGCAAGCAGCAGATTACGCGCAGAAAAAAAGGAT<br>CTCAAGAAGATCCTTTGATCTTTTCTACGGGGTCTGACGCTCAGTGGAACGAAA<br>ACTCACGTTAAGGGATTTTGGTCATGAGATTATCAAAAAGGATCTTCACCTAGA<br>TCCTTTTAAATTAAAAATGAAGTTTTAAATCAATCTAAAGTATATATGAGTAAA<br>CTTGGTCTGACAGTTACCAATGCTTAATCAGTGAGGCACCTATCTCAGCGATCT<br>GTCTATTTCGTTCATCCATAGTTGCCTGACTCCCCGTCGTGTAGATAACTACGA<br>TACGGGAGGGCTTACCATCTGGCCCCAGTGCTGCAATGATACCGCGAGACCCAC<br>GCTCACCGGCTCCAGATTTATCAGCAATAAACCAGCCAGCCGGAAGGGCCGAGC<br>GCAGAAGTGGTCCTGCAACTTTATCCGCCTCCATCCAGTCTATTAATTGTTGCC<br>GGGAAGCTAGAGTAAGTAGTTCGCCAGTTAATAGTTTGCGCAACGTTGTTGCCA<br>TTGCTACAGGCATCGTGGTGTCACGCTCGTCGTTTGGTATGGCTTCATTCAGCT<br>CCGGTTCCCAACGATCAAGGCGAGTTACATGATCCCCATGTTGTGCAAAAAG<br>CGGTTAGCTCCTTCGGTCCTCCGATCGTTGTCAGAAGTAAGTTGGCCGCAGTGT<br>TATCACTCATGGTTATGGCAGCACTGCATAATTCTCTTACTGTCATGCCATCCG<br>TAAGATGCTTTTCTGTGACTGGTGAGTACTCAACCAAGTCATTCTGAGAATAGT<br>GTATGCGGCGACCGAGTTGCTCTTGCCCGGCGTCAATACGGGATAATACCGCGC<br>CACATAGCAGAACTTTAAAAGTGCTCATCATTGGAAAACGTTCTTCGGGGCGAA<br>AACTCTCAAGGATCTTACCGCTGTTGAGATCCAGTTCGATGTAACCCACTCGTG<br>CACCCAACTGATCTTCAGCATCTTTTACTTTCACCAGCGTTTCTGGGTGAGCAA<br>AAACAGGAAGGCAAAATGCCGCAAAAAAGGGAATAAGGGCGACACGGAAATGTT<br>GAATACTCATACTCTTCCTTTTTCAATATTATTGAAGCATTTATCAGGGTTATT<br>GTCTCATGAGCGGATACATATTTGAATGTATTTAGAAAAATAAACAAATAGGGG<br>TTCCGCGCACATTTCCCCGAAAAGTGCCACCTGA |
| 1237 | Plasmid for fusion<br>protein with<br>mRNA002 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG<br>ACGTCAATGGGTGGAGTATTTACGGTAAACTGCCCACTTGGCAGTACATCAAGT<br>GTATCATATGCCAAGTACGCCCCCTATTGACGTCAATGACGGTAAATGGCCCGC<br>CTGGCATTATGCCCAGTACATGACCTTATGGGACTTTCCTACTTGGCAGTACAT<br>CTACGTATTAGTCATCGCTATTACCATGGTGATGCGGTTTTGGCAGTACATCAA |

TABLE 18-continued

Sequence listing.

| SEQ | Description | Sequence |
|---|---|---|
| | | TGGGCGTGGATAGCGGTTTGACTCACGGGGATTTCCAAGTCTCCACCCCATTGA |
| | | CGTCAATGGGAGTTTGTTTTGGCACCAAAATCAACGGGACTTTCCAAAATGTCG |
| | | TAACAACTCCGCCCCATTGACGCAAATGGGCGGTAGGCGTGTACGGTGGGAGGT |
| | | CTATATAAGCAGAGCTCTCTGGCTAACTAGAGAACCCACTGCTTACTGGCTTAT |
| | | CGAAATTAATACGACTCACTATAAGGAGACCCAAGCTACCGGTGCCACCATGTA |
| | | CCCATACGATGTTCCAGATTACGCTTCGCCGAAGAAAAAGCGCAAGGTCAATCA |
| | | CGATCAGGAGTTCGACCCCCCTAAGGTGTACCCACCAGTGCCTGCAGAGAAGAG |
| | | GAAGCCAATCCGGGTGCTGAGCCTGTTTGATGGCATCGCCACCGGCCTGCTGGT |
| | | GCTGAAGGATCTGGGCATCCAGGTGGACCGGTACATCGCCTCCGAGGTGTGCGA |
| | | GGATTCTATCACCGTGGGCATGGTGCGCCACCAGGGCAAGATCATGTATGTGGG |
| | | CGACGTGCGGTCCGTGACACAGAAGCACATCCAGGAGTGGGGCCCATTCGATCT |
| | | GGTGATCGGCGGCAGCCCCTGTAATGACCTGTCCATCGTGAACCCTGCAAGGAA |
| | | GGGACTGTACGAGGGAACCGGCCGGCTGTTCTTTGAGTTTTATAGACTGCTGCA |
| | | CGACGCCAGGCCTAAGGAGGGCGACGATAGACCATTCTTTTGGCTGTTCGAGAA |
| | | TGTGGTGGCTATGGGCGTGAGCGATAAGAGGGACATCTCCAGGTTTCTGGAGTC |
| | | TAACCCCGTGATGATCGATGCAAAGGAGGTGTCCGCCGCACACAGAGCCAGGTA |
| | | TTTCTGGGGCAATCTGCCAGGAATGAACAGGCCACTGGCAAGCACCGTGAATGA |
| | | CAAGCTGGAGCTGCAGGAGTGCCTGGAGCACGGAAGGATCGCCAAGTTTTCCAA |
| | | GGTGCGCACAATCACCACACGGAGCAATTCCATCAAGCAGGGCAAGGATCAGCA |
| | | CTTCCCCGTGTTCATGAACGAGAAGGAGGACATCCTGTGGTGTACCGAGATGGA |
| | | GAGAGTGTTCGGCTTTCCAGTGCACTACACAGACGTGTCTAACATGAGCAGGCT |
| | | GGCAAGGCAGCGGCTGCTGGGCAGATCTTGGAGCGTGCCCGTGATCAGGCACCT |
| | | GTTCGCCCCTCTGAAGGAGTATTTTGCCTGCGTGAGCAGCGGCAACTCCAATGC |
| | | CAACAGCCGGGGCCCCTCTTTCAGCTCCGGATTGGTGCCTCTGAGCCTGAGGGG |
| | | CTCCCACATGGCAGCAATCCCCGCCTGGACCCCGAGGCCGAGCCTAGCATGGA |
| | | CGTGATCCTGGTGGGCTCTAGCGAGCTGTCCTCTAGCGTGTCTCCAGGAACCGG |
| | | AAGGGATCTGATCGCATACGAGGTGAAGGCCAATCAGCGGAACATCGAGGACAT |
| | | CTGTATCTGCTGTGGCAGCCTGCAGGTGCACACACAGCACCCACTGTTCGAGGG |
| | | AGGAATCTGCGCACCCTGTAAGGATAAGTTCCTGGACGCCCTGTTTCTGTACGA |
| | | CGATGACGGCTACCAGTCCTATTGCTCTATCTGCTGTTCCGGCGAGACCCTGCT |
| | | GATCTGCGGCAATCCAGATTGTACAAGGTGCTATTGTTTTGAGTGCGTGGACTC |
| | | TCTGGTGGGACCAGGCACCAGCGAAAGGTGCACGCCATGTCCAACTGGGTGTG |
| | | CTACCTGTGCCTGCCATCCTCTCGCAGCGGACTGCTGCAGCGGAGAAGGAAGTG |
| | | GAGATCCCAGCTGAAGGCCTTCTATGATAGGGAGTCTGAGAACCCCCTGGAGAT |
| | | GTTTGAGACCGTGCCAGTGTGGCGCCGGCAGCCCGTGAGGGTGCTGAGCCTGTT |
| | | CGAGGATATCAAGAAGGAGCTGACATCCCTGGGCTTTCTGGAGTCCGGCTCTGA |
| | | CCCCGGACAGCTGAAGCACGTGGTGGATGTGACCGACACAGTGCGGAAGGATGT |
| | | GGAGGAGTGGGGCCCTTTCGACCTGGTGTACGGAGCAACCCCTCCACTGGGACA |
| | | CACATGCGACAGACCCCCTTCTTGGTACCTGTTCCAGTTTCACCGCCTGCTGCA |
| | | GTATGCAAGGCCAAAGCCAGGCAGCCCTAGACCATTCTTTTGGATGTTCGTGGA |
| | | TAATCTGGTGCTGAACAAGGAGGATCTGGACGTGGCCAGCAGGTTTCTGGAGAT |
| | | GGAGCCAGTGACCATCCCAGACGTGCACGGCGGCTCCCTGCAGAATGCCGTGCG |
| | | CGTGTGGTCTAACATCCCTGCCATCAGAAGCAGGCACTGGGCACTGGTGAGCGA |
| | | GGAGGAGCTGTCCCTGCTGGCCCAGAATAAGCAGAGCAGCAAGCTGGCCGCCAA |
| | | GTGGCCTACAAAGCTGGTGAAGAACTGCTTCCTGCCACTGCGGGAGTACTTCAA |
| | | GTATTTTTCCACCGAGCTGACATCTAGCCTGGGAGGACCCTCCTCTGGCGCCCC |
| | | ACCACCTAGCGGCGGCTCCCCTGCCGGCTCTCCAACCAGCACAGAGGAGGGCAC |
| | | CAGCGAGTCCGCCACACCAGAGTCTGGACCTGGCACCAGCACAGAGCCATCCGA |
| | | GGGCTCTGCCCCAGGCTCTCCTGCAGGCAGCCCTACCTCCACCGAAGAGGGCAC |
| | | CAGCACAGAGCCTTCTGAGGGCAGCGCCCCAGGCACCTCTACAGAGCCAAGCGA |
| | | GCTCGAGTCCCGGCCAGGGGAACGGCCCTTCCAGTGTCGGATCTGCATGAGAAA |
| | | CTTTTCAAAGAAGTTCAATCTGCTTCAGCACACCCGGACCCACACTGGAGAGAA |
| | | ACCCTTTCAGTGCAGGATATGTATGCGGAATTTTTCCCGAAAAGATTACTTGAT |
| | | TAGCCACCTCCGAACACATACCGGGAGTCAGAAGCCTTTCCAATGCCGGATTTG |
| | | CATGAGGAACTTCTCCAGGAGCCACAACCTTAAACTGCACACAAGAACACATAC |
| | | AGGCGAGAAGCCATTCCAGTGTAGGATCTGCATGCGCAATTTTAGCCAATCCAC |
| | | AACATTGAAAAGACATCTTCGGACGCATACAGGTAGTCAGAAGCCTTTTCAGTG |
| | | CAGGATCTGCATGAGGAATTTTAGTCGACAAGATAATCTTGGCCGACATCTTCG |
| | | AACGCATACTGGAGAGAAGCCCTTTCAGTGTAGGATTTGTATGCGGAACTTCAG |
| | | CGTAGTAAACAACTTGAACAGACACTTGAAAACTCATTTGCGCGGGTCTAGCCC |
| | | CAAGAAGAAGAGAAAGGTGGGAGTCGACGGATCCAGCGGCTCCGAGACCCCAGG |
| | | CACATCTGAGAGCGCCACCCCTGAGTCCCGGACCCTGGTGACATTCAAGGACGT |
| | | GTTCGTGGACTTCACCCGGGAGGAGTGGAAGCTGCTGGACACAGCCCAGCAGAT |
| | | CGTGTACAGGAACGTGATGCTGGAGAACTATAAGAATCTGGTGTCTCTGGGCTA |
| | | CCAGCTGACAAAGCCAGATGTGATCCTGCGGCTGGAGAAGGGAGAGGAGCCCTG |
| | | GCTGGTGTAGTCTAGAAATCAACCTCTGGATTACAAAATTTGTGAAAGATTGAC |
| | | TGGTATTCTTAACTATGTTGCTCCTTTTACGCTATGTGGATACGCTGCTTTAAT |
| | | GCCTTTGTATCATGCTATTGCTTCCCGTATGGCTTTCATTTTCTCCTCCTTGTA |
| | | TAAATCCTGGTTGCTGTCTCTTTATGAGGAGTTGTGGCCCGTTGTCAGGCAACG |
| | | TGGCGTGGTGTGCACTGTGTTTGCTGACGCAACCCCCACTGGTTGGGGCATTGC |
| | | CACCACCTGTCAGCTCCTTTCCGGGACTTTCGCTTTCCCCCTCCCTATTGCCAC |
| | | GGCGGAACTCATCGCCGCCTGCCTTGCCCGCTGCTGGACAGGGGCTCGGCTGTT |
| | | GGGCACTGACAATTCCGTGGTGTTGTCGGGGAAATCATCGTCCTTTCCTTGGCT |
| | | GCTCGCCTGTGTTGCCACCTGGATTCTGCGCGGGACGTCCTTCTGCTACGTCCC |
| | | TTCGGCCCTCAATCCAGCGGACCTTCCTTCCCGCGGCCTGCTGCCGGCTCTGCG |
| | | GCCTCTTCCGCGTCTTCGCCTTCGCCCTCAGACGAGTCGGATCTCCCTTTGGGC |

TABLE 18-continued

Sequence listing.

| SEQ | Description | Sequence |
|---|---|---|
| | | CGCCTCCCCGCCTGTTAATTAAAAAAAAAAAAAAAAAAAAAAAAAAAAAAAAA
AAAAAAAAAAAAAAAAAACTAGTGGCGCCTGATGCGGTATTTTCTCCTTACGCA
TCTGTGCGGTATTTCACACCGCATAATCCAGCACAGTGGCGGCCCGTTTAAACC
CGCTGATCAGCCTCGACTGTGCCTTCTAGTTGCCAGCCATCTGTTGTTTGCCCC
TCCCCCGTGCCTTCCTTGACCCTGGAAGGTGCCACTCCCACTGTCCTTTCCTAA
TAAAATGAGGAAATTGCATCGCATTGTCTGAGTAGGTGTCATTCTATTCTGGGG
GGTGGGGTGGGGCAGGACAGCAAGGGGGAGGATTGGGAAGACAATAGCAGGCAT
GCTGGGGATGCGGTGGGCTCTATGGCTTCTGAGGCGGAAAGAACCAGCTGCATT
AATGAATCGGCCAACGCGCGGGGAGAGGCGGTTTGCGTATTGGGCGCTCTTCCG
CTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAG
GAAAGAACATGTGAGCAAAAGGCCAGCAAAAGGCCAGGAACCGTAAAAAGGCCG
CGTTGCTGGCGTTTTTCCATAGGCTCCGCCCCCCTGACGAGCATCACAAAAATC
GACGCTCAAGTCAGAGGTGGCGAAACCCGACAGGACTATAAAGATACCAGGCGT
TTCCCCCTGGAAGCTCCCTCGTGCGCTCTCCTGTTCCGACCCTGCCGCTTACCG
GATACCTGTCCGCCTTTCTCCCTTCGGGAAGCGTGGCGCTTTCTCATAGCTCAC
GCTGTAGGTATCTCAGTTCGGTGTAGGTCGTTCGCTCCAAGCTGGGCTGTGTGC
ACGAACCCCCCGTTCAGCCCGACCGCTGCGCCTTATCCGGTAACTATCGTCTTG
AGTCCAACCCGGTAAGACACGACTTATCGCCACTGGCAGCAGCCACTGGTAACA
GGATTAGCAGAGCGAGGTATGTAGGCGGTGCTACAGAGTTCTTGAAGTGGTGGC
CTAACTACGGCTACACTAGAAGAACAGTATTTGGTATCTGCGCTCTGCTGAAGC
CAGTTACCTTCGGAAAAAGAGTTGGTAGCTCTTGATCCGGCAAACAAACCACCG
CTGGTAGCGGTTTTTTTGTTTGCAAGCAGCAGATTACGCGCAGAAAAAAAGGAT
CTCAAGAAGATCCTTTGATCTTTTCTACGGGGTCTGACGCTCAGTGGAACGAAA
ACTCACGTTAAGGGATTTTGGTCATGAGATTATCAAAAAGGATCTTCACCTAGA
TCCTTTTAAATTAAAAATGAAGTTTTAAATCAATCTAAAGTATATATGAGTAAA
CTTGGTCTGACAGTTACCAATGCTTAATCAGTGAGGCACCTATCTCAGCGATCT
GTCTATTTCGTTCATCCATAGTTGCCTGACTCCCCGTCGTGTAGATAACTACGA
TACGGGAGGGCTTACCATCTGGCCCCAGTGCTGCAATGATACCGCGAGACCCAC
GCTCACCGGCTCCAGATTTATCAGCAATAAACCAGCCAGCCGGAAGGGCCGAGC
GCAGAAGTGGTCCTGCAACTTTATCCGCCTCCATCCAGTCTATTAATTGTTGCC
GGGAAGCTAGAGTAAGTAGTTCGCCAGTTAATAGTTTGCGCAACGTTGTTGCCA
TTGCTACAGGCATCGTGGTGTCACGCTCGTCGTTTGGTATGGCTTCATTCAGCT
CCGGTTCCCAACGATCAAGGCGAGTTACATGATCCCCATGTTGTGCAAAAAAG
CGGTTAGCTCCTTCGGTCCTCCGATCGTTGTCAGAAGTAAGTTGGCCGCAGTGT
TATCACTCATGGTTATGGCAGCACTGCATAATTCTCTTACTGTCATGCCATCCG
TAAGATGCTTTTCTGTGACTGGTGAGTACTCAACCAAGTCATTCTGAGAATAGT
GTATGCGGCGACCGAGTTGCTCTTGCCCGGCGTCAATACGGGATAATACCGCGC
CACATAGCAGAACTTTAAAAGTGCTCATCATTGGAAAACGTTCTTCGGGGCGAA
AACTCTCAAGGATCTTACCGCTGTTGAGATCCAGTTCGATGTAACCCACTCGTG
CACCCAACTGATCTTCAGCATCTTTTACTTTCACCAGCGTTTCTGGGTGAGCAA
AAACAGGAAGGCAAAATGCCGCAAAAAAGGGAATAAGGGCGACACGGAAATGTT
GAATACTCATACTCTTCCTTTTTCAATATTATTGAAGCATTTATCAGGGTTATT
GTCTCATGAGCGGATACATATTTGAATGTATTTAGAAAAATAAACAAATAGGGG
TTCCGCGCACATTTCCCCGAAAAGTGCCACCTGA |
| 1238 | Plasmid for fusion protein with mRNA0003 | CGTCGATCGACGGATCGGGAGATCTCCCGATCCCCTATGGTGCACTCTCAGTAC
AATCTGCTCTGATGCCGCATAGTTAAGCCAGTATCTGCTCCCTGCTTGTGTGTT
GGAGGTCGCTGAGTAGTGCGCGAGCAAAATTTAAGCTACAACAAGGCAAGGCTT
GACCGACAATTGCATGAAGAATCTGCTTAGGGTTAGGCGTTTTGCGCTGCTTCG
CGATGTACGGGCCAGATATACGCGTTGACATTGATTATTGACTAGTTATTAATA
GTAATCAATTACGGGGTCATTAGTTCATAGCCCATATATGGAGTTCCGCGTTAC
ATAACTTACGGTAAATGGCCCGCCTGGCTGACCGCCCAACGACCCCCGCCCATT
GACGTCAATAATGACGTATGTTCCCATAGTAACGCCAATAGGGACTTTCCATTG
ACGTCAATGGGTGGAGTATTTACGGTAAACTGCCCACTTGGCAGTACATCAAGT
GTATCATATGCCAAGTACGCCCCCTATTGACGTCAATGACGGTAAATGGCCCGC
CTGGCATTATGCCCAGTACATGACCTTATGGGACTTTCCTACTTGGCAGTACAT
CTACGTATTAGTCATCGCTATTACCATGGTGATGCGGTTTTGGCAGTACATCAA
TGGGCGTGGATAGCGGTTTGACTCACGGGGATTTCCAAGTCTCCACCCCATTGA
CGTCAATGGGAGTTTGTTTTGGCACCAAAATCAACGGGACTTTCCAAAATGTCG
TAACAACTCCGCCCCATTGACGCAAATGGGCGGTAGGCGTGTACGGTGGGAGGT
CTATATAAGCAGAGCTCTCTGGCTAACTAGAGAACCCACTGCTTACTGGCTTAT
CGAAATTAATACGACTCACTATAAGGAGACCCAAGCTACCGGTGCCACCATGTA
CCCATACGATGTTCCAGATTACGCTTCGCCGAAGAAAAAGCGCAAGGTCAATCA
CGATCAGGAGTTCGACCCCCCTAAGGTGTACCCACCAGTGCCTGCAGAGAAGAG
GAAGCCAATCCGGGTGCTGAGCCTGTTTGATGGCATCGCCACCGGCCTGCTGGT
GCTGAAGGATCTGGGCATCCAGGTGGACCGGTACATCGCCTCCGAGGTGTGCGA
GGATTCTATCACCGTGGGCATGGTGCGCCACCAGGGCAAGATCATGTATGTGGG
CGACGTGCGGTCCGTGACACAGAAGCACATCCAGGAGTGGGGCCCATTCGATCT
GGTGATCGGCGGCAGCCCCTGTAATGACCTGTCCATCGTGAACCCTGCAAGGAA
GGGACTGTACGAGGGAACCGGCCGGCTGTTCTTTGAGTTTTATAGACTGCTGCA
CGACGCCAGGCCTAAGGAGGGCGACGATAGACCATTCTTTTGGCTGTTCGAGAA
TGTGGTGGCTATGGGCGTGAGCGATAAGAGGGACATCTCCAGGTTTCTGGAGTC
TAACCCCGTGATGATCGATGCAAAGGAGGTGTCCGCCGCACACAGAGCCAGGTA
TTTCTGGGGCAATCTGCCAGGAATGAACAGGCCACTGGCAAGCACCGTGAATGA
CAAGCTGGAGCTGCAGGAGTGCCTGGAGCACGGAAGGATCGCCAAGTTTTCCAA |

TABLE 18-continued

Sequence listing.

| SEQ | Description | Sequence |
|---|---|---|
| | | GGTGCGCACAATCACCACACGGAGCAATTCCATCAAGCAGGGCAAGGATCAGCA
CTTCCCCGTGTTCATGAACGAGAAGGAGGACATCCTGTGGTGTACCGAGATGGA
GAGAGTGTTCGGCTTTCCAGTGCACTACACAGACGTGTCTAACATGAGCAGGCT
GGCAAGGCAGCGGCTGCTGGGCAGATCTTGGAGCGTGCCCGTGATCAGGCACCT
GTTCGCCCCTCTGAAGGAGTATTTTGCCTGCGTGAGCAGCGGCAACTCCAATGC
CAACAGCCGGGGCCCCTCTTTCAGCTCCGGATTGTGCCTCTGAGCCTGAGGGG
CTCCCACATGGCAGCAATCCCCGCCCTGGACCCCGAGGCCGAGCCTAGCATGGA
CGTGATCCTGGTGGGCTCTAGCGAGCTGTCCTCTAGCGTGTCTCCAGGAACCGG
AAGGGATCTGATCGCATACGAGGTGAAGGCCAATCAGCGGAACATCGAGGACAT
CTGTATCTGCTGTGGCAGCCTGCAGGTGCACACACAGCACCCACTGTTCGAGGG
AGGAATCTGCGCACCCTGTAAGGATAAGTTCCTGGACGCCCTGTTTCTGTACGA
CGATGACGGCTACCAGTCCTATTGCTCTATCTGCTGTTCCGGCGAGACCCTGCT
GATCTGCGGCAATCCAGATTGTACAAGGTGCTATTGTTTTGAGTGCGTGGACTC
TCTGGTGGGACCAGGCACCAGCGGAAAGGTGCACGCCATGTCCAACTGGGTGTG
CTACCTGTGCCTGCCATCCTCTCGCAGCGGACTGCTGCAGCGGAGAAGGAAGTG
GAGATCCCAGCTGAAGGCCTTCTATGATAGGGAGTCTGAGAACCCCCTGGAGAT
GTTTGAGACCGTGCCAGTGTGGCGCCGGCAGCCCGTGAGGGTGCTGAGCCTGTT
CGAGGATATCAAGAAGGAGCTGACATCCCTGGGCTTTCTGGAGTCCGGCTCTGA
CCCCGGACAGCTGAAGCACGTGGTGGATGTGACCGACACAGTCGGAAGGATGT
GGAGGAGTGGGGCCCTTTCGACCTGGTGTACGGAGCAACCCCTCCACTGGGACA
CACATGCGACAGACCCCCCTTCTTGGTACCTGTTCCAGTTTCACCGCCTGCTGCA
GTATGCAAGGCCAAAGCCAGGCAGCCCTAGACCATTCTTTTGGATGTTCGTGGA
TAATCTGGTGCTGAACAAGGAGGATCTGGACGTGGCCAGCAGGTTTCTGGAGAT
GGAGCCAGTGACCATCCCAGACGTGCACGGCGGCTCCCTGCAGAATGCCGTGCG
CGTGTGGTCTAACATCCCTGCCATCAGAAGCAGGCACTGGGCACTGGTGAGCGA
GGAGGAGCTGTCCCTGCTGGCCCAGAATAAGAGAGCAGCAAGCTGGCCGCCAA
GTGGCCTACAAAGCTGGTGAAGAACTGCTTCCTGCCACTGCGGGAGTACTTCAA
GTATTTTTCCACCGAGCTGACATCTAGCCTGGGAGGACCCTCCTCTGGCGCCCC
ACCACCTAGCGGCGGCTCCCCTGCCGGCTCTCCAACCAGCACAGAGGAGGGCAC
CAGCGAGTCCGCCACACCAGAGTCTGGACCTGGCACCAGCACAGAGCCATCCGA
GGGCTCTGCCCCAGGCTCTCCTGCAGGCAGCCCTACCTCCACCGAAGAGGGCAC
CAGCACAGAGCCTTCTGAGGGCAGCGCCCCAGGCACCTCTACAGAGCCAAGCGA
GCTCGAGTCCCGGCCAGGGGAACGGCCCTTCCAGTGTCGGATCTGCATGAGAAA
CTTTTCAAAAAAGTTTAACCTTCTCCAACACACACGAACCCACACTGGAGAGAA
ACCCTTTCAGTGCAGGATATGTATGCGGAATTTTTCCAGAAAAGATTATTTGAT
CAGTCATCTGCGAACACATACCGGGAGTCAGAAGCCTTTCCAATGCCGGATTTG
CATGAGGAACTTCTCCAGGAGTCATAACCTCCGGTTGCACACACGCACACATAC
AGGCGAGAAGCCATTCCAGTGTAGGATCTGCATGCGCAATTTTAGCCAGAGTAC
GACCCTGAAGAGACATCTGCGGACGCATACAGGTAGTCAGAAGCCTTTTCAGTG
CAGGATCTGCATGAGGAATTTTAGTCGGCAAGATAATTTGGGGAGACACTTGAG
AACGCATACTGGAGAGAAGCCCTTTCAGTGTAGGATTTGTATGCGGAACTTCAG
CGTTGTGAATAATTTGAATCGGCATCTCAAAACTCATTTGCGCGGGTCTAGCCC
CAAGAAGAAGAGAAAGGTGGGAGTCGACGGATCCAGCGGCTCCGAGACCCCAGG
CACATCTGAGAGCGCCACCCCTGAGTCCCGGACCCTGGTGACATTCAAGGACGT
GTTCGTGGACTTCACCCGGGAGGAGTGGAAGCTGCTGGACACAGCCCAGCAGAT
CGTGTACAGGAACGTGATGCTGGAGAACTATAAGAATCTGGTGTCTCTGGGCTA
CCAGCTGACAAAGCCAGATGTGATCCTGCGGCTGGAGAAGGGAGAGGAGCCCTG
GCTGGTGTAGTCTAGAAATCAACCTCTGGATTACAAAATTTGTGAAAGATTGAC
TGGTATTCTTAACTATGTTGCTCCTTTTACGCTATGTGGATACGCTGCTTTAAT
GCCTTTGTATCATGCTATTGCTTCCCGTATGGCTTTCATTTTCTCCTCCTTGTA
TAAATCCTGGTTGCTGTCTCTTTATGAGGAGTTGTGGCCCGTTGTCAGGCAACG
TGGCGTGGTGTGCACTGTGTTTGCTGACGCAACCCCCACTGGTTGGGGCATTGC
CACCACCTGTCAGCTCCTTTCCGGGACTTTCGCTTTCCCCCTCCCTATTGCCAC
GGCGGAACTCATCGCCGCCTGCCTTGCCCGCTGCTGGACAGGGGCTCGGCTGTT
GGGCACTGACAATTCCGTGGTGTTGTCGGGGAAATCATCGTCCTTTCCTTGGCT
GCTCGCCTGTGTTGCCACCTGGATTCTGCGCGGGACGTCCTTCTGCTACGTCCC
TTCGGCCCTCAATCCAGCGGACCTTCCTTCCCGCGGCCTGCTGCCGGCTCTGCG
GCCTCTTCCGCGTCTTCGCCTTCGCCCTCAGACGAGTCGGATCTCCCTTTGGGC
CGCCTCCCCGCCTGTTAATTAAAAAAAAAAAAAAAAAAAAAAAAAAAAAAAAAA
AAAAAAAAAAAAAAAACTAGTGGCGCCTGATGCGGTATTTTCTCCTTACGCA
TCTGTGCGGTATTTCACACCGCATAATCCAGCACAGTGGCGGCCCGTTTAAACC
CGCTGATCAGCCTCGACTGTGCCTTCTAGTTGCCAGCCATCTGTTGTTTGCCCC
TCCCCCGTGCCTTCCTTGACCCTGGAAGGTGCCACTCCCACTGTCCTTTCCTAA
TAAAATGAGGAAATTGCATCGCATTGTCTGAGTAGGTGTCATTCTATTCTGGGG
GGTGGGGTGGGCAGGACAGCAAGGGGAGGATTGGGAAGACAATAGCAGGCAT
GCTGGGGATGCGGTGGGCTCTATGGCTTCTGAGGCGGAAAGAACCAGCTGCATT
AATGAATCGGCCAACGCGCGGGGAGAGGCGGTTTGCGTATTGGGCGCTCTTCCG
CTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAG
GAAAGAACATGTGAGCAAAAGGCCAGCAAAAGGCCAGGAACCGTAAAAAGGCCG
CGTTGCTGGCGTTTTTCCATAGGCTCCGCCCCCCTGACGAGCATCACAAAAATC
GACGCTCAAGTCAGAGGTGGCGAAACCCGACAGGACTATAAAGATACCAGGCGT
TTCCCCCTGGAAGCTCCCTCGTGCGCTCTCCTGTTCCGACCCTGCCGCTTACCG
GATACCTGTCCGCCTTTCTCCCTTCGGGAAGCGTGGCGCTTTCTCATAGCTCAC
GCTGTAGGTATCTCAGTTCGGTGTAGGTCGTTCGCTCCAAGCTGGGCTGTGTGC
ACGAACCCCCCGTTCAGCCCGACCGCTGCGCCTTATCCGGTAACTATCGTCTTG |

TABLE 18-continued

Sequence listing.

| SEQ | Description | Sequence |
|---|---|---|
| | | AGTCCAACCCGGTAAGACACGACTTATCGCCACTGGCAGCAGCCACTGGTAACA<br>GGATTAGCAGAGCGAGGTATGTAGGCGGTGCTACAGAGTTCTTGAAGTGGTGGC<br>CTAACTACGGCTACACTAGAAGAACAGTATTTGGTATCTGCGCTCTGCTGAAGC<br>CAGTTACCTTCGGAAAAAGAGTTGGTAGCTCTTGATCCGGCAAACAAACCACCG<br>CTGGTAGCGGTTTTTTTGTTTGCAAGCAGCAGATTACGCGCAGAAAAAAAGGAT<br>CTCAAGAAGATCCTTTGATCTTTTCTACGGGGTCTGACGCTCAGTGGAACGAAA<br>ACTCACGTTAAGGGATTTTGGTCATGAGATTATCAAAAAGGATCTTCACCTAGA<br>TCCTTTTAAATTAAAAATGAAGTTTTAAATCAATCTAAAGTATATATGAGTAAA<br>CTTGGTCTGACAGTTACCAATGCTTAATCAGTGAGGCACCTATCTCAGCGATCT<br>GTCTATTTCGTTCATCCATAGTTGCCTGACTCCCCGTCGTGTAGATAACTACGA<br>TACGGGAGGGCTTACCATCTGGCCCCAGTGCTGCAATGATACCGCGAGACCCAC<br>GCTCACCGGCTCCAGATTTATCAGCAATAAACCAGCCAGCCGGAAGGGCCGAGC<br>GCAGAAGTGGTCCTGCAACTTTATCCGCCTCCATCCAGTCTATTAATTGTTGCC<br>GGGAAGCTAGAGTAAGTAGTTCGCCAGTTAATAGTTTGCGCAACGTTGTTGCCA<br>TTGCTACAGGCATCGTGGTGTCACGCTCGTCGTTTGGTATGGCTTCATTCAGCT<br>CCGGTTCCCAACGATCAAGGCGAGTTACATGATCCCCATGTTGTGCAAAAAAG<br>CGGTTAGCTCCTTCGGTCCTCCGATCGTTGTCAGAAGTAAGTTGGCCGCAGTGT<br>TATCACTCATGGTTATGGCAGCACTGCATAATTCTCTTACTGTCATGCCATCCG<br>TAAGATGCTTTTCTGTGACTGGTGAGTACTCAACCAAGTCATTCTGAGAATAGT<br>GTATGCGGCGACCGAGTTGCTCTTGCCCGGCGTCAATACGGGATAATACCGCGC<br>CACATAGCAGAACTTTAAAAGTGCTCATCATTGGAAAACGTTCTTCGGGGCGAA<br>AACTCTCAAGGATCTTACCGCTGTTGAGATCCAGTTCGATGTAACCCACTCGTG<br>CACCCAACTGATCTTCAGCATCTTTTACTTTCACCAGCGTTTCTGGGTGAGCAA<br>AAACAGGAAGGCAAAATGCCGCAAAAAAGGGAATAAGGGCGACACGGAAATGTT<br>GAATACTCATACTCTTCCTTTTTCAATATTATTGAAGCATTTATCAGGGTTATT<br>GTCTCATGAGCGGATACATATTTGAATGTATTTAGAAAAATAAACAAATAGGGG<br>TTCCGCGCACATTTCCCCGAAAAGTGCCACCTGA |
| 1239 | Plasmid for fusion protein with mRNA0004 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG<br>ACGTCAATGGGTGGAGTATTTACGGTAAACTGCCCACTTGGCAGTACATCAAGT<br>GTATCATATGCCAAGTACGCCCCCTATTGACGTCAATGACGGTAAATGGCCCGC<br>CTGGCATTATGCCCAGTACATGACCTTATGGGACTTTCCTACTTGGCAGTACAT<br>CTACGTATTAGTCATCGCTATTACCATGGTGATGCGGTTTTGGCAGTACATCAA<br>TGGGCGTGGATAGCGGTTTGACTCACGGGGATTTCCAAGTCTCCACCCCATTGA<br>CGTCAATGGGAGTTTGTTTTGGCACCAAAATCAACGGGACTTTCCAAAATGTCG<br>TAACAACTCCGCCCCATTGACGCAAATGGGCGGTAGGCGTGTACGGTGGGAGGT<br>CTATATAAGCAGAGCTCTCTGGCTAACTAGAGAACCCACTGCTTACTGGCTTAT<br>CGAAATTAATACGACTCACTATAAGGAGACCCAAGCTACCGGTGCCACCATGTA<br>CCCATACGATGTTCCAGATTACGCTTCGCCGAAGAAAAAGCGCAAGGTCAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA<br>TGTGGTGGCTATGGGCGTGAGCGATAAGAGGGACATCTCCAGGTTTCTGGAGTC<br>TAACCCCGTGATGATCGATGCAAAGGAGGTGTCCGCCGCACACAGAGCCAGGTA<br>TTTCTGGGGCAATCTGCCAGGAATGAACAGGCCACTGGCAAGCACCGTGAATGA<br>CAAGCTGGAGCTGCAGGAGTGCCTGGAGCACGGAAGGATCGCCAAGTTTTCCAA<br>GGTGCGCACAATCACCACACGGAGCAATTCCATCAAGCAGGGCAAGGATCAGCA<br>CTTCCCCGTGTTCATGAACGAGAAGGAGGACATCCTGTGGTGTACCGAGATGGA<br>GAGAGTGTTCGGCTTTCCAGTGCACTACACAGACGTGTCTAACATGAGCAGGCT<br>GGCAAGGCAGCGGCTGCTGGGCAGATCTTGGAGCGTGCCCGTGATCAGGCACCT<br>GTTCGCCCCTCTGAAGGAGTATTTTGCCTGCGTGAGCAGCGGCAACTCCAATGC<br>CAACAGCCGGGGCCCCTCTTTCAGCTCCGGATTGGTGCCTCTGAGCCTGAGGGG<br>CTCCCACATGGCAGCAATCCCCGCCTGGACCCCGAGGCCGAGCCTAGCATGGA<br>CGTGATCCTGGTGGGCTCTAGCGAGCTGTCCTCTAGCGTGTCTCCAGGAACCGG<br>AAGGGATCTGATCGCATACGAGGTGAAGGCCAATCAGCGGAACATCGAGGACAT<br>CTGTATCTGCTGTGGCAGCCTGCAGGTGCACACACAGCACCCACTGTTCGAGGG<br>AGGAATCTGCGCACCCTGTAAGGATAAGTTCCTGGACGCCCTGTTTCTGTACGA<br>CGATGACGGCTACCAGTCCTATTGCTCTATCTGCTGTTCCGGCGAGACCCTGCT<br>GATCTGCGGCAATCCAGATTGTACAAGGTGCTATTGTTTTGAGTGCGTGGACTC<br>TCTGGTGGGACCAGGCACCAGCGGAAAGGTGCACGCCATGTCCAACTGGGTGTG<br>CTACCTGTGCCTGCCATCCTCTCGCAGCGGACTGCTGCAGCGGAGAAGGAAGTG<br>GAGATCCCAGCTGAAGGCCTTCTATGATAGGGAGTCTGAGAACCCCCTGGAGAT<br>GTTTGAGACCGTGCCAGTGTGGCGCCGGCAGCCCCGTGAGGGTGCTGAGCCTGTT<br>CGAGGATATCAAGAAGGAGCTGACATCCCTGGGCTTTCTGGAGTCCGGCTCTGA |

TABLE 18-continued

Sequence listing.

| SEQ | Description | Sequence |
|---|---|---|
| | | CCCCGGACAGCTGAAGCACGTGGTGGATGTGACCGACACAGTGCGGAAGGATGT |
| | | GGAGGAGTGGGGCCCTTTCGACCTGGTGTACGGAGCAACCCCTCCACTGGGACA |
| | | CACATGCGACAGACCCCCTTCTTGGTACCTGTTCCAGTTTCACCGCCTGCTGCA |
| | | GTATGCAAGGCCAAAGCCAGGCAGCCCTAGACCATTCTTTTGGATGTTCGTGGA |
| | | TAATCTGGTGCTGAACAAGGAGGATCTGGACGTGGCCAGCAGGTTTCTGGAGAT |
| | | GGAGCCAGTGACCATCCCAGACGTGCACGGCGGCTCCCTGCAGAATGCCGTGCG |
| | | CGTGTGGTCTAACATCCCTGCCATCAGAAGCAGGCACTGGGCACTGGTGAGCGA |
| | | GGAGGAGCTGTCCCTGCTGGCCCAGAATAAGCAGAGCAGCAAGCTGGCCGCCAA |
| | | GTGGCCTACAAAGCTGGTGAAGAACTGCTTCCTGCCACTGCGGGAGTACTTCAA |
| | | GTATTTTTCCACCGAGCTGACATCTAGCCTGGGAGGACCCTCCTCTGGCGCCCC |
| | | ACCACCTAGCGGCGGCTCCCCTGCCGGCTCTCCAACCAGCACAGAGGAGGGCAC |
| | | CAGCGAGTCCGCCACACCAGAGTCTGGACCTGGCACCAGCACAGAGCCATCCGA |
| | | GGGCTCTGCCCCAGGCTCTCCTGCAGGCAGCCCTACCTCCACCGAAGAGGGCAC |
| | | CAGCACAGAGCCTTCTGAGGGCAGCGCCCCAGGCACCTCTACAGAGCCAAGCGA |
| | | GCTCGAGTCCCGGCCAGGGGAACGGCCCTTCCAGTGTCGGATCTGCATGAGAAA |
| | | CTTTTCACGACGCCACATTTTGGACAGACATACTCGGACCCACACTGGAGAGAA |
| | | ACCCTTTCAGTGCAGGATATGTATGCGGAATTTTTCCCGCCAGGACAACTTGGG |
| | | GCGGCATCTGCGCACACATACCGGGAGTCAGAAGCCTTTCCAATGCCGGATTTG |
| | | CATGAGGAACTTCTCCCAATCTACCACTCTTAAACGACACTTGCGCACACATAC |
| | | AGGCGAGAAGCCATTCCAGTGTAGGATCTGCATGCGCAATTTTAGCCGCCGGGA |
| | | CGGCCTGGCAGGGCACCTTAAGACGCATACAGGTAGTCAGAAGCCTTTTCAGTG |
| | | CAGGATCTGCATGAGGAATTTTAGTGTTCATCATAACCTCGTTAGGCATCTGAG |
| | | AACGCATACTGGAGAGAAGCCCTTTCAGTGTAGGATTTGTATGCGGAACTTCAG |
| | | CATCAGTCACAATTTGGCGCGGCACCTTAAGACTCATTTGCGCGGGTCTAGCCC |
| | | CAAGAAGAAGAGAAAGGTGGGAGTCGACGGATCCAGCGGCTCCGAGACCCCAGG |
| | | CACATCTGAGAGCGCCACCCCTGAGTCCCGGACCCTGGTGACATTCAAGGACGT |
| | | GTTCGTGGACTTCACCCGGGAGGAGTGGAAGCTGCTGGACACAGCCCAGCAGAT |
| | | CGTGTACAGGAACGTGATGCTGGAGAACTATAAGAATCTGGTGTCTCTGGGCTA |
| | | CCAGCTGACAAAGCCAGATGTGATCCTGCGGCTGGAGAAGGGAGAGGAGCCCTG |
| | | GCTGGTGTAGTCTAGAAATCAACCTCTGGATTACAAAATTTGTGAAAGATTGAC |
| | | TGGTATTCTTAACTATGTTGCTCCTTTTACGCTATGTGGATACGCTGCTTTAAT |
| | | GCCTTTGTATCATGCTATTGCTTCCCGTATGGCTTTCATTTTCTCCTCCTTGTA |
| | | TAAATCCTGGTTGCTGTCTCTTTATGAGGAGTTGTGGCCCGTTGTCAGGCAACG |
| | | TGGCGTGGTGTGCACTGTGTTTGCTGACGCAACCCCCACTGGTTGGGGCATTGC |
| | | CACCACCTGTCAGCTCCTTTCCGGGACTTTCGCTTTCCCCCTCCCTATTGCCAC |
| | | GGCGGAACTCATCGCCGCCTGCCTTGCCCGCTGCTGGACAGGGGCTCGGCTGTT |
| | | GGGCACTGACAATTCCGTGGTGTTGTCGGGGAAATCATCGTCCTTTCCTTGGCT |
| | | GCTCGCCTGTGTTGCCACCTGGATTCTGCGCGGGACGTCCTTCTGCTACGTCCC |
| | | TTCGGCCCTCAATCCAGCGGACCTTCCTTCCCGCGGCCTGCTGCCGGCTCTGCG |
| | | GCCTCTTCCGCGTCTTCGCCTTCGCCCTCAGACGAGTCGGATCTCCCTTTGGGC |
| | | CGCCTCCCCGCCTGTTAATTAAAAAAAAAAAAAAAAAAAAAAAAAAAAAAAAAA |
| | | AAAAAAAAAAAAAAAAAACTAGTGGCGCCTGATGCGGTATTTTCTCCTTACGCA |
| | | TCTGTGCGGTATTTCACACCGCATAATCCAGCACAGTGGCGGCCCGTTTAAACC |
| | | CGCTGATCAGCCTCGACTGTGCCTTCTAGTTGCCAGCCATCTGTTGTTTGCCCC |
| | | TCCCCCGTGCCTTCCTTGACCCTGGAAGGTGCCACTCCCACTGTCCTTTCCTAA |
| | | TAAAATGAGGAAATTGCATCGCATTGTCTGAGTAGGTGTCATTCTATTCTGGGG |
| | | GGTGGGGTGGGGCAGGACAGCAAGGGGGAGGATTGGGAAGACAATAGCAGGCAT |
| | | GCTGGGGATGCGGTGGGCTCTATGGCTTCTGAGGCGGAAAGAACCAGCTGCATT |
| | | AATGAATCGGCCAACGCGCGGGGAGAGGCGGTTTGCGTATTGGGCGCTCTTCCG |
| | | CTTCCTCGCTCACTGACTCGCTGCGCTCGGTCGTTCGGCTGCGGCGAGCGGTAT |
| | | CAGCTCACTCAAAGGCGGTAATACGGTTATCCACAGAATCAGGGGATAACGCAG |
| | | GAAAGAACATGTGAGCAAAAGGCCAGCAAAAGGCCAGGAACCGTAAAAAGGCCG |
| | | CGTTGCTGGCGTTTTTCCATAGGCTCCGCCCCCCTGACGAGCATCACAAAAATC |
| | | GACGCTCAAGTCAGAGGTGGCGAAACCCGACAGGACTATAAAGATACCAGGCGT |
| | | TTCCCCCTGGAAGCTCCCTCGTGCGCTCTCCTGTTCCGACCCTGCCGCTTACCG |
| | | GATACCTGTCCGCCTTTCTCCCTTCGGGAAGCGTGGCGCTTTCTCATAGCTCAC |
| | | GCTGTAGGTATCTCAGTTCGGTGTAGGTCGTTCGCTCCAAGCTGGGCTGTGTGC |
| | | ACGAACCCCCCGTTCAGCCCGACCGCTGCGCCTTATCCGGTAACTATCGTCTTG |
| | | AGTCCAACCCGGTAAGACACGACTTATCGCCACTGGCAGCAGCCACTGGTAACA |
| | | GGATTAGCAGAGCGAGGTATGTAGGCGGTGCTACAGAGTTCTTGAAGTGGTGGC |
| | | CTAACTACGGCTACACTAGAAGAACAGTATTTGGTATCTGCGCTCTGCTGAAGC |
| | | CAGTTACCTTCGGAAAAAGAGTTGGTAGCTCTTGATCCGGCAAACAAACCACCG |
| | | CTGGTAGCGGTTTTTTTGTTTGCAAGCAGCAGATTACGCGCAGAAAAAAAGGAT |
| | | CTCAAGAAGATCCTTTGATCTTTTCTACGGGGTCTGACGCTCAGTGGAACGAAA |
| | | ACTCACGTTAAGGGATTTTGGTCATGAGATTATCAAAAAGGATCTTCACCTAGA |
| | | TCCTTTTAAATTAAAAATGAAGTTTTAAATCAATCTAAAGTATATATGAGTAAA |
| | | CTTGGTCTGACAGTTACCAATGCTTAATCAGTGAGGCACCTATCTCAGCGATCT |
| | | GTCTATTTCGTTCATCCATAGTTGCCTGACTCCCCGTCGTGTAGATAACTACGA |
| | | TACGGGAGGGCTTACCATCTGGCCCCAGTGCTGCAATGATACCGCGAGACCCAC |
| | | GCTCACCGGCTCCAGATTTATCAGCAATAAACCAGCCAGCCGGAAGGGCCGAGC |
| | | GCAGAAGTGGTCCTGCAACTTTATCCGCCTCCATCCAGTCTATTAATTGTTGCC |
| | | GGGAAGCTAGAGTAAGTAGTTCGCCAGTTAATAGTTTGCGCAACGTTGTTGCCA |
| | | TTGCTACAGGCATCGTGGTGTCACGCTCGTCGTTTGGTATGGCTTCATTCAGCT |
| | | CCGGTTCCCAACGATCAAGGCGAGTTACATGATCCCCATGTTGTGCAAAAAAG |
| | | CGGTTAGCTCCTTCGGTCCTCCGATCGTTGTCAGAAGTAAGTTGGCCGCAGTGT |
| | | TATCACTCATGGTTATGGCAGCACTGCATAATTCTCTTACTGTCATGCCATCCG |

TABLE 18-continued

Sequence listing.

| SEQ | Description | Sequence |
|---|---|---|
| | | TAAGATGCTTTTCTGTGACTGGTGAGTACTCAACCAAGTCATTCTGAGAATAGT<br>GTATGCGGCGACCGAGTTGCTCTTGCCCGGCGTCAATACGGGATAATACCGCGC<br>CACATAGCAGAACTTTAAAAGTGCTCATCATTGGAAAACGTTCTTCGGGGCGAA<br>AACTCTCAAGGATCTTACCGCTGTTGAGATCCAGTTCGATGTAACCCACTCGTG<br>CACCCAACTGATCTTCAGCATCTTTTACTTTCACCAGCGTTTCTGGGTGAGCAA<br>AAACAGGAAGGCAAAATGCCGCAAAAAAGGGAATAAGGGCGACACGGAAATGTT<br>GAATACTCATACTCTTCCTTTTTCAATATTATTGAAGCATTTATCAGGGTTATT<br>GTCTCATGAGCGGATACATATTTGAATGTATTTAGAAAAATAAACAAATAGGGG<br>TTCCGCGCACATTTCCCCGAAAAGTGCCACCTGA |
| 1240 | Plasmid for fusion protein with mRNA0005 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG<br>ACGTCAATGGGTGGAGTATTTACGGTAAACTGCCCACTTGGCAGTACATCAAGT<br>GTATCATATGCCAAGTACGCCCCCTATTGACGTCAATGACGGTAAATGGCCCGC<br>CTGGCATTATGCCCAGTACATGACCTTATGGGACTTTCCTACTTGGCAGTACAT<br>CTACGTATTAGTCATCGCTATTACCATGGTGATGCGGTTTTGGCAGTACATCAA<br>TGGGCGTGGATAGCGGTTTGACTCACGGGGATTTCCAAGTCTCCACCCCATTGA<br>CGTCAATGGGAGTTTGTTTTGGCACCAAAATCAACGGGACTTTCCAAAATGTCG<br>TAACAACTCCGCCCCATTGACGCAAATGGGCGGTAGGCGTGTACGGTGGGAGGT<br>CTATATAAGCAGAGCTCTCTGGCTAACTAGAGAACCCACTGCTTACTGGCTTAT<br>CGAAATTAATACGACTCACTATAAGGAGACCCAAGCTACCGGTGCCACCATGTA<br>CCCATACGATGTTCCAGATTACGCTTCGCCGAAGAAAAGCGCAAGGTCAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA<br>TGTGGTGGCTATGGGCGTGAGCGATAAGAGGGACATCTCCAGGTTTCTGGAGTC<br>TAACCCCGTGATGATCGATGCAAAGGAGGTGTCCGCCGCACACAGAGCCAGGTA<br>TTTCTGGGCAATCTGCCAGGAATGAACAGGCCACTGGCAAGCACCGTGAATGA<br>CAAGCTGGAGCTGCAGGAGTGCCTGGAGCACGGAAGGATCGCCAAGTTTTCCAA<br>GGTGCGCACAATCACCACACGGAGCAATTCCATCAAGCAGGGCAAGGATCAGCA<br>CTTCCCCGTGTTCATGAACGAGAAGGAGGACATCCTGTGGTGTACCGAGATGGA<br>GAGAGTGTTCGGCTTTCCAGTGCACTACACAGACGTGTCTAACATGAGCAGGCT<br>GGCAAGGCAGCGGCTGCTGGGCAGATCTTGGAGCGTGCCCGTGATCAGGCACCT<br>GTTCGCCCCTCTGAAGGAGTATTTTGCCTGCGTGAGCAGCGGCAACTCCAATGC<br>CAACAGCCGGGGCCCCTCTTTCAGCTCCGGATTGGTGCCTCTGAGCCTGAGGGG<br>CTCCCACATGGCAGCAATCCCCGCCCTGGACCCCGAGGCCGAGCCTAGCATGGA<br>CGTGATCCTGGTGGGCTCTAGCGAGCTGTCCTCTAGCGTGTCTCCAGGAACCGG<br>AAGGGATCTGATCGCATACGAGGTGAAGGCCAATCAGCGGAACATCGAGGACAT<br>CTGTATCTGCTGTGGCAGCCTGCAGGTGCACACACAGCACCCACTGTTCGAGGG<br>AGGAATCTGCGCACCCTGTAAGGATAAGTTCCTGGACGCCCTGTTTCTGTACGA<br>CGATGACGGCTACCAGTCCTATTGCTCTATCTGCTGTTCCGGCGAGACCCTGCT<br>GATCTGCGGCAATCCAGATTGTACAAGGTGCTATTGTTTTGAGTGCGTGGACTC<br>TCTGGTGGGACCAGGCACCAGCGGAAAGGTGCACGCCATGTCCAACTGGGTGTG<br>CTACCTGTGCCTGCCATCCTCTCGCAGCGGACTGCTGCAGCGGAGAAGGAAGTG<br>GAGATCCCAGCTGAAGGCCTTCTATGATAGGGAGTCTGAGAACCCCCTGGAGAT<br>GTTTGAGACCGTGCCAGTGTGGCGCCGGCAGCCCGTGAGGGTGCTGAGCCTGTT<br>CGAGGATATCAAGAAGGAGCTGACATCCCTGGGCTTTCTGGAGTCCGGCTCTGA<br>CCCCGGACAGCTGAAGCACGTGGTGGATGTGACCGACACAGTGCGGAAGGATGT<br>GGAGGAGTGGGGCCCTTTCGACCTGGTGTACGGAGCAACCCCTCCACTGGGACA<br>CACATGCGACAGACCCCCTTCTTGGTACCTGTTCCAGTTTCACCGCCTGCTGCA<br>GTATGCAAGGCAAAGCCAGGCAGCCCTAGACCATTCTTTTGGATGTTCGTGGA<br>TAATCTGGTGCTGAACAAGGAGGATCTGGACGTGGCCAGCAGGTTTCTGGAGAT<br>GGAGCCAGTGACCATCCCAGACGTGCACGGCGGCTCCCTGCAGAATGCCGTGCG<br>CGTGTGGTCTAACATCCCTGCCATCAGAAGCAGGCACTGGGCACTGGTGAGCGA<br>GGAGGAGCTGTCCCTGCTGGCCCAGAATAAGCAGAGCAGCAAGCTGGCCGCCAA<br>GTGGCCTACAAAGCTGGTGAAGAACTGCTTCCTGCCCACTGCGGGAGTACTTCAA<br>GTATTTTTCCACCGAGCTGACATCTAGCCTGGGAGGACCCTCCTCTGGCGCCCC<br>ACCACCTAGCGGCGGCTCCCCTGCCGGCTCTCCAACCAGCACAGAGGAGGGCAC<br>CAGCGAGTCCGCCACACCAGAGTCTGGACCTGGCACCAGCACAGAGCCATCCGA<br>GGGCTCTGCCCAGGCTCTCCTGCAGGCACCCTACCCTCCACCGAAGAGGGCAC<br>CAGCACAGAGCCTTCTGAGGGCAGCGCCCCAGGCACCTCTACAGAGCCAAGCGA<br>GCTCGAGTCCCGGCCAGGGGAACGGCCCTTCCAGTGTCGGATCTGCATGAGAAA<br>CTTTTCACGCCGGGAGGTATTGGAAAACCATTTGCGAACCCACACTGGAGAGAA<br>ACCCTTTCAGTGCAGGATATGTATGCGGAATTTTTCCCGGCGGGATAATCTCAA<br>TCGGCACTTGAAAACACATACCGGGAGTCAGAAGCCTTTCCAATGCCGGATTTG |

TABLE 18-continued

Sequence listing.

| SEQ | Description | Sequence |
|---|---|---|
| | | CATGAGGAACTTCTCCCAATCCACTACCCTCAAGCGACATCTGCGGACACATAC<br>AGGCGAGAAGCCATTCCAGTGTAGGATCTGCATGCGCAATTTTAGCCGAAGGGA<br>TGGGCTGGCGGGCCATCTTAAGACGCATACAGGTAGTCAGAAGCCTTTTCAGTG<br>CAGGATCTGCATGAGGAATTTTAGTGTCATCACAACCTGGTCAGACACCTTAG<br>GACGCATACTGGAGAGAAGCCCTTTCAGTGTAGGATTTGTATGCGGAACTTCAG<br>CATATCACATAACCTTGCCCGACACTTGAAGACTCATTTGCGCGGGTCTAGCCC<br>CAAGAAGAAGAGAAAGGTGGGAGTCGACGGATCCAGCGGCTCCGAGACCCCAGG<br>CACATCTGAGAGCGCCACCCCTGAGTCCCGGACCCTGGTGACATTCAAGGACGT<br>GTTCGTGGACTTCACCCGGGAGGAGTGGAAGCTGCTGGACACAGCCCAGCAGAT<br>CGTGTACAGGAACGTGATGCTGGAGAACTATAAGAATCTGGTGTCTCTGGGCTA<br>CCAGCTGACAAAGCCAGATGTGATCCTGCGGCTGGAGAAGGGAGAGGAGCCCTG<br>GCTGGTGTAGTCTAGAAATCAACCTCTGGATTACAAAATTTGTGAAAGATTGAC<br>TGGTATTCTTAACTATGTTGCTCCTTTTACGCTATGTGGATACGCTGCTTTAAT<br>GCCTTTGTATCATGCTATTGCTTCCCGTATGGCTTTCATTTTCTCCTCCTTGTA<br>TAAATCCTGGTTGCTGTCTCTTTATGAGGAGTTGTGGCCCGTTGTCAGGCAACG<br>TGGCGTGGTGTGCACTGTGTTTGCTGACGCAACCCCCACTGGTTGGGGCATTGC<br>CACCCACCTGTCAGCTCCTTTCCGGGACTTTCGCTTTCCCCCTCCCTATTGCCAC<br>GGCGGAACTCATCGCCGCCTGCCTTGCCCGCTGCTGGACAGGGGCTCGGCTGTT<br>GGGCACTGACAATTCCGTGGTGTTGTCGGGGAAATCATCGTCCTTTCCTTGGCT<br>GCTCGCCTGTGTTGCCACCTGGATTCTGCGCGGGACGTCCTTCTGCTACGTCCC<br>TTCGGCCCTCAATCCAGCGGACCTTCCTTCCCGGCCTGCTGCCGGCTCTGCG<br>GCCTCTTCCGCGTCTTCGCCTTCGCCCTCAGACGAGTCGGATCTCCCTTTGGGC<br>CGCCTCCCCGCCTGTTAATTAAAAAAAAAAAAAAAAAAAAAAAAAAAAAAAAAAAA<br>AAAAAAAAAAAAAAAAAAACTAGTGGCGCCTGATGCGGTATTTTCTCCTTACGCA<br>TCTGTGCGGTATTTCACACCGCATAATCCAGCACAGTGGCGGCCCGTTTAAACC<br>CGCTGATCAGCCTCGACTGTGCCTTCTAGTTGCCAGCCATCTGTTGTTTGCCCC<br>TCCCCCGTGCCTTCCTTGACCCTGGAAGGTGCCACTCCCACTGTCCTTTCCTAA<br>TAAAATGAGGAAATTGCATCGCATTGTCTGAGTAGGTGTCATTCTATTCTGGGG<br>GGTGGGGTGGGGCAGGACAGCAAGGGGGAGGATTGGGAAGACAATAGCAGGCAT<br>GCTGGGGATGCGGTGGGCTCTATGGCTTCTGAGGCGGAAAGAACCAGCTGCATT<br>AATGAATCGGCCAACGCGCGGGGAGAGGCGGTTTGCGTATTGGGCGCTCTTCCG<br>CTTCCTCGCTCACTGACTCGCTGCGCTCGGTCGTTCGGCTGCGGCGAGCGGTAT<br>CAGCTCACTCAAAGGCGGTAATACGGTTATCCACAGAATCAGGGGATAACGCAG<br>GAAAGAACATGTGAGCAAAAGGCCAGCAAAAGGCCAGGAACCGTAAAAAGGCCG<br>CGTTGCTGGCGTTTTTCCATAGGCTCCGCCCCCTGACGAGCATCACAAAAATC<br>GACGCTCAAGTCAGAGGTGGCGAAACCCGACAGGACTATAAAGATACCAGGCGT<br>TTCCCCCTGGAAGCTCCCTCGTGCGCTCTCCTGTTCCGACCCTGCCGCTTACCG<br>GATACCTGTCCGCCTTTCTCCCTTCGGGAAGCGTGGCGCTTTCTCATAGCTCAC<br>GCTGTAGGTATCTCAGTTCGGTGTAGGTCGTTCGCTCCAAGCTGGGCTGTGTGC<br>ACGAACCCCCCGTTCAGCCCGACCGCTGCGCCTTATCCGGTAACTATCGTCTTG<br>AGTCCAACCCGGTAAGACACGACTTATCGCCACTGGCAGCAGCCACTGGTAACA<br>GGATTAGCAGAGCGAGGTATGTAGGCGGTGCTACAGAGTTCTTGAAGTGGTGGC<br>CTAACTACGGCTACACTAGAAGAACAGTATTTGGTATCTGCGCTCTGCTGAAGC<br>CAGTTACCTTCGGAAAAAGAGTTGGTAGCTCTTGATCCGGCAAACAAACCACCG<br>CTGGTAGCGGTTTTTTTGTTTGCAAGCAGCAGATTACGCGCAGAAAAAAAGGAT<br>CTCAAGAAGATCCTTTGATCTTTTCTACGGGGTCTGACGCTCAGTGGAACGAAA<br>ACTCACGTTAAGGGATTTTGGTCATGAGATTATCAAAAAGGATCTTCACCTAGA<br>TCCTTTTAAATTAAAAATGAAGTTTTAAATCAATCTAAAGTATATATGAGTAAA<br>CTTGGTCTGACAGTTACCAATGCTTAATCAGTGAGGCACCTATCTCAGCGATCT<br>GTCTATTTCGTTCATCCATAGTTGCCTGACTCCCCGTCGTGTAGATAACTACGA<br>TACGGGAGGGCTTACCATCTGGCCCCAGTGCTGCAATGATACCGCGAGACCCAC<br>GCTCACCGGCTCCAGATTTATCAGCAATAAACCAGCCAGCCGGAAGGGCCGAGC<br>GCAGAAGTGGTCCTGCAACTTTATCCGCCTCCATCCAGTCTATTAATTGTTGCC<br>GGGAAGCTAGAGTAAGTAGTTCGCCAGTTAATAGTTTGCGCAACGTTGTTGCCA<br>TTGCTACAGGCATCGTGGTGTCACGCTCGTCGTTTGGTATGGCTTCATTCAGCT<br>CCGGTTCCCAACGATCAAGGCGAGTTACATGATCCCCATGTTGTGCAAAAAAG<br>CGGTTAGCTCCTTCGGTCCTCCGATCGTTGTCAGAAGTAAGTTGGCCGCAGTGT<br>TATCACTCATGGTTATGGCAGCACTGCATAATTCTCTTACTGTCATGCCATCCG<br>TAAGATGCTTTTCTGTGACTGGTGAGTACTCAACCAAGTCATTCTGAGAATAGT<br>GTATGCGGCGACCGAGTTGCTCTTGCCCGGCGTCAATACGGGATAATACCGCGC<br>CACATAGCAGAACTTTAAAAGTGCTCATCATTGGAAAACGTTCTTCGGGGCGAA<br>AACTCTCAAGGATCTTACCGCTGTTGAGATCCAGTTCGATGTAACCCACTCGTG<br>CACCCAACTGATCTTCAGCATCTTTTACTTTCACCAGCGTTTCTGGGTGAGCAA<br>AAACAGGAAGGCAAAATGCCGCAAAAAAGGGAATAAGGGCGACACGGAAATGTT<br>GAATACTCATACTCTTCCTTTTTCAATATTATTGAAGCATTTATCAGGGTTATT<br>GTCTCATGAGCGGATACATATTTGAATGTATTTAGAAAAATAAACAAATAGGGG<br>TTCCGCGCACATTTCCCCGAAAAGTGCCACCTGA |
| 1241 | Plasmid for fusion fusion protein with mRNA0006 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG |

TABLE 18-continued

Sequence listing.

| SEQ | Description | Sequence |
|---|---|---|
| | | ACGTCAATGGGTGGAGTATTTACGGTAAACTGCCCACTTGGCAGTACATCAAGT
GTATCATATGCCAAGTACGCCCCCTATTGACGTCAATGACGGTAAATGGCCCGC
CTGGCATTATGCCCAGTACATGACCTTATGGGACTTTCCTACTTGGCAGTACAT
CTACGTATTAGTCATCGCTATTACCATGGTGATGCGGTTTTGGCAGTACATCAA
TGGGCGTGGATAGCGGTTTGACTCACGGGGATTTCCAAGTCTCCACCCCATTGA
CGTCAATGGGAGTTTGTTTTGGCACCAAAATCAACGGGACTTTCCAAAATGTCG
TAACAACTCCGCCCCATTGACGCAAATGGGCGGTAGGCGTGTACGGTGGGAGGT
CTATATAAGCAGAGCTCTCTGGCTAACTAGAGAACCCACTGCTTACTGGCTTAT
CGAAATTAATACGACTCACTATAAGGAGACCCAAGCTACCGGTGCCACCATGTA
CCCATACGATGTTCCAGATTACGCTTCGCCGAAGAAAAAGCGCAAGGTCAATCA
CGATCAGGAGTTCGACCCCCCTAAGGTGTACCCACCAGTGCCTGCAGAAGAGAG
GAAGCCAATCCGGGTGCTGAGCCTGTTTGATGGCATCGCCACCGGCCTGCTGGT
GCTGAAGGATCTGGGCATCCAGGTGGACCGGTACATCGCCTCCGAGGTGTGCGA
GGATTCTATCACCGTGGGCATGGTGCGCCACCAGGGCAAGATCATGTATGTGGG
CGACGTGCGGTCCGTGACACAGAAGCACATCCAGGAGTGGGGCCCATTCGATCT
GGTGATCGGCGGCAGCCCCTGTAATGACCTGTCCATCGTGAACCCTGCAAGGAA
GGGACTGTACGAGGGAACCGGCCGGCTGTTCTTTGAGTTTTATAGACTGCTGCA
CGACGCCAGGCCTAAGGAGGGCGACGATAGACCATTCTTTTGGCTGTTCGAGAA
TGTGGTGGCTATGGGCGTGAGCGATAAGAGGGACATCTCCAGGTTTCTGGAGTC
TAACCCCGTGATGATCGATGCAAAGGAGGTGTCCGCCGCACACAGAGCCAGGTA
TTTCTGGGGCAATCTGCCAGGAATGAACAGGCCACTGGCAAGCACCGTGAATGA
CAAGCTGGAGCTGCAGGAGTGCCTGGAGCACGGAAGGATCGCCAAGTTTTCCAA
GGTGCGCACAATCACCACACGGAGCAATTCCATCAAGCAGGGCAAGGATCAGCA
CTTCCCCGTGTTCATGAACGAGAAGGAGGACATCCTGTGGTGTACCGAGATGGA
GAGAGTGTTCGGCTTTCCAGTGCACTAACACAGACGTGTCTAACATGAGCAGGCT
GGCAAGGCAGCGGCTGCTGGGCAGATCTTGGAGCGTGCCCGTGATCAGGCACCT
GTTCGCCCCTCTGAAGGAGTATTTTGCCTGCGTGAGCAGCGGCAACTCCAATGC
CAACAGCCGGGGCCCCTCTTTCAGCTCCGGATTGGTGCCTCTGAGCCTGAGGGG
CTCCCACATGGCAGCAATCCCCGCCTGGACCCCGAGGCCGAGCCTAGCATGGA
CGTGATCCTGGTGGGCTCTAGCGAGCTGTCCTCTAGCGTGTCTCCAGGAACCGG
AAGGGATCTGATCGCATACGAGGTGAAGGCCAATCAGCGGAACATCGAGGACAT
CTGTATCTGCTGTGGCAGCCTGCAGGTGCACACACAGCACCCACTGTTCGAGGG
AGGAATCTGCGCACCCTGTAAGGATAAGTTCCTGGACGCCCTGTTTCTGTACGA
CGATGACGGCTACCAGTCCTATTGCTCTATCTGCTGTTCCGGCGAGACCCTGCT
GATCTGCGGCAATCCAGATTGTACAAGGTGCTATTGTTTTGAGTGCGTGGACTC
TCTGGTGGGACCAGGCACCAGCGGAAAGGTGCACGCCATGTCCAACTGGGTGTG
CTACCTGTGCCTGCCATCCTCTCGCAGCGGACTGCTGCAGCGGAGAAGGAAGTG
GAGATCCCAGCTGAAGGCCTTCTATGATAGGGAGTCTGAGAACCCCCTGGAGAT
GTTTGAGACCGTGCCAGTGTGGCGCCGGCAGCCCGTGAGGGTGCTGAGCCTGTT
CGAGGATATCAAGAAGGAGCTGACATCCCTGGGCTTTCTGGAGTCCGGCTCTGA
CCCCGGACAGCTGAAGCACGTGGTGGATGTGACCGACACAGTGCGGAAGGATGT
GGAGGAGTGGGGCCCTTTCGACCTGGTGTACGGAGCAACCCCTCCACTGGGACA
CACATGCGACAGACCCCCTTCTTGGTACCTGTTCCAGTTTCACCGCCTGCTGCA
GTATGCAAGGCCAAAGCCAGGCAGCCCTAGACCATTCTTTTGGATGTTCGTGGA
TAATCTGGTGCTGAACAAGGAGGATCTGGACGTGGCCAGCAGGTTTCTGGAGAT
GGAGCCAGTGACCATCCCAGACGTGCACGGCGGCTCCCTGCAGAATGCCGTGCG
CGTGTGGTCTAACATCCCTGCCATCAGAAGCAGGCACTGGGCACTGGTGAGCGA
GGAGGAGCTGTCCCTGCTGGCCCAGAATAAGCAGAGCAGCAAGCTGGCCGCCAA
GTGGCCTACAAAGCTGGTGAAGAACTGCTTCCTGCCACTGCGGGAGTACTTCAA
GTATTTTTTCCACCGAGCTGACATCTAGCCTGGGAGGACCCTCCTCTGGCGCCCC
ACCACCTAGCGGCGGCTCCCCTGCCGGCTCTCCAACCAGCACAGAGGAGGGCAC
CAGCGAGTCCGCCACACCAGAGTCTGGACCTGGCACCAGCACAGAGCCATCCGA
GGGCTCTGCCCCAGGCTCTCCTGCAGGCAGCCCTACCTCCACCGAAGAGGGCAC
CAGCACAGAGCCTTCTGAGGGCAGCGCCCCAGGCACCTCTACAGAGCCAAGCGA
GCTCGAGTCCCGGCCAGGGGAACGGCCCTTCCAGTGTCGGATCTGCATGAGAAA
CTTTTCACGCAGGGCAGTGTTGGATAGACATACCCGGACCCACACTGGAGAGAA
ACCCTTTCAGTGCAGGATATGTATGCGGAATTTTTCCCGACAAGATAATCTGGG
GAGGCATCTGCGGACACATACCGGGATTCAGAAGCCTTTCCAATGCCGGATTTG
CATGAGGAACTTCTCCCAATCAACTACCCTGAAGCGACATCTGCGCACACATAC
AGGCGAGAAGCCATTCCAGTGTAGGATCTGCATGCGCAATTTTAGCCGCCGCGA
TGGGCTGGCTGGACACCTGAAGACGCATACAGGTAGTCAGAAGCCTTTTCAGTG
CAGGATCTGCATGAGGAATTTTAGTGTTCATCACAACTTGGTCCGACACCTTCG
GACGCATACTGGAGAGAAGCCCTTTCAGTGTAGGATTTGTATGCGGAACTTCAG
CATTTCACACAACCTCGCGCGCCACTTGAAAACTCATTTGCGCGGGTCTAGCCC
CAAGAAGAAGAGAAAGGTGGGAGTCGACGGATCCAGCGGCTCCGAGACCCCAGG
CACATCTGAGAGCGCCACCCCTGAGTCCCGGACCCTGGTGACATTCAAGGACGT
GTTCGTGGACTTCACCCGGGAGGAGTGGAAGCTGCTGGACACAGCCCAGCAGAT
CGTGTACAGGAACGTGATGCTGGAGAACTATAAGAATCTGGTGTCTCTGGGCTA
CCAGCTGACAAAGCCAGATGTGATCCTGCGGCTGGAGAAGGGAGAGGAGCCCTG
GCTGGTGTAGTCTAGAAATCAACCTCTGGATTACAAAATTTGTGAAAGATTGAC
TGGTATTCTTAACTATGTTGCTCCTTTTACGCTATGTGGATACGCTGCTTTAAT
GCCTTTGTATCATGCTATTGCTTCCCGTATGGCTTTCATTTTCTCCTCCTTGTA
TAAATCCTGGTTGCTGTCTCTTTATGAGGAGTTGTGGCCCGTTGTCAGGCAACG
TGGCGTGGTGTGCACTGTGTTTGCTGACGCAACCCCCACTGGTTGGGGCATTGC
CACCACCTGTCAGCTCCTTTCCGGGACTTTCGCTTTCCCCCTCCCTATTGCCAC
GGCGGAACTCATCGCCGCCTGCCTTGCCCGCTGCTGGACAGGGGCTCGGCTGTT |

TABLE 18-continued

Sequence listing.

| SEQ | Description | Sequence |
|---|---|---|
| | | GGGCACTGACAATTCCGTGGTGTTGTCGGGGAAATCATCGTCCTTTCCTTGGCT<br>GCTCGCCTGTGTTGCCACCTGGATTCTGCGCGGGACGTCCTTCTGCTACGTCCC<br>TTCGGCCCTCAATCCAGCGGACCTTCCTTCCCGCGGCCTGCTGCCGGCTCTGCG<br>GCCTCTTCCGCGTCTTCGCCTTCGCCCTCAGACGAGTCGGATCTCCCTTTGGGC<br>CGCCTCCCCGCCTGTTAATTAAAAAAAAAAAAAAAAAAAAAAAAAAAAAAAAAA<br>AAAAAAAAAAAAAAAAAACTAGTGGCGCCTGATGCGGTATTTTCTCCTTACGCA<br>TCTGTGCGGTATTTCACACCGCATAATCCAGCACAGTGGCGGCCCGTTTAAACC<br>CGCTGATCAGCCTCGACTGTGCCTTCTAGTTGCCAGCCATCTGTTGTTTGCCCC<br>TCCCCCGTGCCTTCCTTGACCCTGGAAGGTGCCACTCCCACTGTCCTTTCCTAA<br>TAAAATGAGGAAATTGCATCGCATTGTCTGAGTAGGTGTCATTCTATTCTGGGG<br>GGTGGGGTGGGGCAGGACAGCAAGGGGGAGGATTGGGAAGACAATAGCAGGCAT<br>GCTGGGGATGCGGTGGGCTCTATGGCTTCTGAGGCGGAAAGAACCAGCTGCATT<br>AATGAATCGGCCAACGCGCGGGGAGAGGCGGTTTGCGTATTGGGCGCTCTTCCG<br>CTTCCTCGCTCACTGACTCGCTGCGCTCGGTCGTTCGGCTGCGGCGAGCGGTAT<br>CAGCTCACTCAAAGGCGGTAATACGGTTATCCACAGAATCAGGGGATAACGCAG<br>GAAAGAACATGTGAGCAAAAGGCCAGCAAAAGGCCAGGAACCGTAAAAAGGCCG<br>CGTTGCTGGCGTTTTTCCATAGGCTCCGCCCCCCTGACGAGCATCACAAAAATC<br>GACGCTCAAGTCAGAGGTGGCGAAACCCGACAGGACTATAAAGATACCAGGCGT<br>TTCCCCCTGGAAGCTCCCTCGTGCGCTCTCCTGTTCCGACCCTGCCGCTTACCG<br>GATACCTGTCCGCCTTTCTCCCTTCGGGAAGCGTGGCGCTTTCTCATAGCTCAC<br>GCTGTAGGTATCTCAGTTCGGTGTAGGTCGTTCGCTCCAAGCTGGGCTGTGTGC<br>ACGAACCCCCCGTTCAGCCCGACCGCTGCGCCTTATCCGGTAACTATCGTCTTG<br>AGTCCAACCCGGTAAGACACGACTTATCGCCACTGGCAGCAGCCACTGGTAACA<br>GGATTAGCAGAGCGAGGTATGTAGGCGGTGCTACAGAGTTCTTGAAGTGGTGGC<br>CTAACTACGGCTACACTAGAAGAACAGTATTTGGTATCTGCGCTCTGCTGAAGC<br>CAGTTACCTTCGGAAAAAGAGTTGGTAGCTCTTGATCCGGCAAACAAACCACCG<br>CTGGTAGCGGTTTTTTTGTTTGCAAGCAGCAGATTACGCGCAGAAAAAAAGGAT<br>CTCAAGAAGATCCTTTGATCTTTTCTACGGGGTCTGACGCTCAGTGGAACGAAA<br>ACTCACGTTAAGGGATTTTGGTCATGAGATTATCAAAAAGGATCTTCACCTAGA<br>TCCTTTTAAATTAAAAATGAAGTTTTAAATCAATCTAAAGTATATATGAGTAAA<br>CTTGGTCTGACAGTTACCAATGCTTAATCAGTGAGGCACCTATCTCAGCGATCT<br>GTCTATTTCGTTCATCCATAGTTGCCTGACTCCCCGTCGTGTAGATAACTACGA<br>TACGGGAGGGCTTACCATCTGGCCCCAGTGCTGCAATGATACCGCGAGACCCAC<br>GCTCACCGGCTCCAGATTTATCAGCAATAAACCAGCCAGCCGGAAGGGCCGAGC<br>GCAGAAGTGGTCCTGCAACTTTATCCGCCTCCATCCAGTCTATTAATTGTTGCC<br>GGGAAGCTAGAGTAAGTAGTTCGCCAGTTAATAGTTTGCGCAACGTTGTTGCCA<br>TTGCTACAGGCATCGTGGTGTCACGCTCGTCGTTTGGTATGGCTTCATTCAGCT<br>CCGGTTCCCAACGATCAAGGCGAGTTACATGATCCCCCATGTTGTGCAAAAAAG<br>CGGTTAGCTCCTTCGGTCCTCCGATCGTTGTCAGAAGTAAGTTGGCCGCAGTGT<br>TATCACTCATGGTTATGGCAGCACTGCATAATTCTCTTACTGTCATGCCATCCG<br>TAAGATGCTTTTCTGTGACTGGTGAGTACTCAACCAAGTCATTCTGAGAATAGT<br>GTATGCGGCGACCGAGTTGCTCTTGCCCGGCGTCAATACGGGATAATACCGCGC<br>CACATAGCAGAACTTTAAAAGTGCTCATCATTGGAAAACGTTCTTCGGGGCGAA<br>AACTCTCAAGGATCTTACCGCTGTTGAGATCCAGTTCGATGTAACCCACTCGTG<br>CACCCAACTGATCTTCAGCATCTTTTACTTTCACCAGCGTTTCTGGGTGAGCAA<br>AAACAGGAAGGCAAATGCCGCAAAAAAGGGAATAAGGGCGACACGGAAATGTT<br>GAATACTCATACTCTTCCTTTTTCAATATTATTGAAGCATTTATCAGGGTTATT<br>GTCTCATGAGCGGATACATATTTGAATGTATTTAGAAAAATAAACAAATAGGGG<br>TTCCGCGCACATTTCCCCGAAAAGTGCCACCTGA |
| 1242 | Plasmid for fusion protein with mRNA0021 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG<br>ACGTCAATGGGTGGAGTATTTACGGTAAACTGCCCACTTGGCAGTACATCAAGT<br>GTATCATATGCCAAGTACGCCCCTATTGACGTCAATGACGGTAAATGGCCCGC<br>CTGGCATTATGCCCAGTACATGACCTTATGGGACTTTCCTACTTGGCAGTACAT<br>CTACGTATTAGTCATCGCTATTACCATGGTGATGCGGTTTTGGCAGTACATCAA<br>TGGGCGTGGATAGCGGTTTGACTCACGGGGATTTCCAAGTCTCCACCCCATTGA<br>CGTCAATGGGAGTTTGTTTTGGCACCAAAATCAACGGGACTTTCCAAAATGTCG<br>TAACAACTCCGCCCCATTGACGCAAATGGGCGGTAGGCGTGTACGGTGGGAGGT<br>CTATATAAGCAGAGCTCTCTGGCTAACTAGAGAACCCACTGCTTACTGGCTTAT<br>CGAAATTAATACGACTCACTATAAGGAGACCCAAGCTACCGGTGCCACCATGTA<br>CCCATACGATGTTCCAGATTACGCTTCGCCGAAGAAAAAGCGCAAGGTCAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA |

TABLE 18-continued

Sequence listing.

| SEQ | Description | Sequence |
|---|---|---|
| | | TGTGGTGGCTATGGGCGTGAGCGATAAGAGGGACATCTCCAGGTTTCTGGAGTC |
| | | TAACCCCGTGATGATCGATGCAAAGGAGGTGTCCGCCGCACACAGAGCCAGGTA |
| | | TTTCTGGGCAATCTGCCAGGAATGAACAGGCCACTGGCAAGCACCGTGAATGA |
| | | CAAGCTGGAGCTGCAGGAGTGCCTGGAGCACGGAAGGATCGCCAAGTTTTCCAA |
| | | GGTGCGCACAATCACCACACGGAGCAATTCCATCAAGCAGGGCAAGGATCAGCA |
| | | CTTCCCCGTGTTCATGAACGAGAAGGAGGACATCCTGTGGTGTACCGAGATGGA |
| | | GAGAGTGTTCGGCTTTCCAGTGCACTACACAGACGTGTCTAACATGAGCAGGCT |
| | | GGCAAGGCAGCGGCTGCTGGGCAGATCTTGGAGCGTGCCCGTGATCAGGCACCT |
| | | GTTCGCCCCTCTGAAGGAGTATTTTGCCTGCGTGAGCAGCGGCAACTCCAATGC |
| | | CAACAGCCGGGGCCCCTCTTTCAGCTCCGGATTGGTGCCTCTGAGCCTGAGGGG |
| | | CTCCCACATGGCAGCAATCCCCGCCCTGGACCCGAGGCCGAGCCTAGCATGGA |
| | | CGTGATCCTGGTGGGCTCTAGCGAGCTGTCCTCTAGCGTGTCTCCAGGAACCGG |
| | | AAGGGATCTGATCGCATACGAGGTGAAGGCCAATCAGCGGAACATCGAGGACAT |
| | | CTGTATCTGCTGTGGCAGCCTGCAGGTGCACACACAGCACCCACTGTTCGAGGG |
| | | AGGAATCTGCGCACCCTGTAAGGATAAGTTCCTGGACGCCCTGTTTCTGTACGA |
| | | CGATGACGGCTACCAGTCCTATTGCTCTATCTGCTGTTCCGGCGAGACCCTGCT |
| | | GATCTGCGGCAATCCAGATTGTACAAGGTGCTATTGTTTTGAGTGCGTGGACTC |
| | | TCTGGTGGGACCAGGCACCAGCGGAAAGGTGCACGCCATGTCCAACTGGGTGTG |
| | | CTACCTGTGCCTGCCATCCTCTCGCAGCGGACTGCTGCAGCGGAGAAGGAAGTG |
| | | GAGATCCCAGCTGAAGGCCTTCTATGATAGGGAGTCTGAGAACCCCCTGGAGAT |
| | | GTTTGAGACCGTGCCAGTGTGGCGCCGGCAGCCCGTGAGGGTGCTGAGCCTGTT |
| | | CGAGGATATCAAGAAGGAGCTGACATCCCTGGGCTTTCTGGAGTCCGGCTCTGA |
| | | CCCCGGACAGCTGAAGCACGTGGTGGATGTGACCGACACAGTCGGAAGGATGT |
| | | GGAGGAGTGGGGCCCTTTCGACCTGGTGTACGGAGCAACCCCTCCACTGGGACA |
| | | CACATGCGACAGACCCCCTTCTTGGTACCTGTTCCAGTTTCACCGCCTGCTGCA |
| | | GTATGCAAGGCCAAAGCCAGGCAGCCCTAGACCATTCTTTTGGATGTTCGTGGA |
| | | TAATCTGGTGCTGAACAAGGAGGATCTGGACGTGGCCAGCAGGTTTCTGGAGAT |
| | | GGAGCCAGTGACCATCCCAGACGTGCACGGCGGCTCCCTGCAGAATGCCGTGCG |
| | | CGTGTGGTCTAACATCCCTGCCATCAGAAGCAGGCACTGGGCACTGGTGAGCGA |
| | | GGAGGAGCTGTCCCTGCTGGCCCAGAATAAGCAGAGCAGCAAGCTGGCCGCCAA |
| | | GTGGCCTACAAAGCTGGTGAAGAACTGCTTCCTGCCACTGCGGGAGTACTTCAA |
| | | GTATTTTTCCACCGAGCTGACATCTAGCCTGGGAGGACCCTCCTCTGGCGCCCC |
| | | ACCACCTAGCGGCGGCTCCCCTGCCGGCTCTCCAACCAGCACAGAGGAGGGCAC |
| | | CAGCGAGTCCGCCACACCAGAGTCTGGACCTGGCACCAGCACAGAGCCATCCGA |
| | | GGGCTCTGCCCCAGGCTCTCCTGCAGGCAGCCCTACCTCCACCGAAGAGGGCAC |
| | | CAGCACAGAGCCTTCTGAGGGCAGCGCCCCAGGCACCTCTACAGAGCCAAGCGA |
| | | GCTCGAGTCCCGGCCAGGGGAACGGCCCTTCCAGTGTCGGATCTGCATGAGAAA |
| | | CTTTTCAAGAGCAGATAATCTGGGTCGGCACCTCCGCACCCACACTGGAGAGAA |
| | | ACCCTTTCAGTGCAGGATATGTATGCGGAATTTTTCCCGCAACACGCATCTCAG |
| | | TTATCACCTTAAAACACATACCGGGAGTCAGAAGCCTTTCCAATGCCGGATTTG |
| | | CATGAGGAACTTCTCCAGGGGCGACGGCTTGAGGCGGCATCTTCGCACACATAC |
| | | AGGCGAGAAGCCATTCCAGTGTAGGATCTGCATGCGCAATTTTAGCCGCAGAGA |
| | | CAATTTGAACAGACATCTCAAAACGCATACAGGTAGTCAGAAGCCTTTTCAGTG |
| | | CAGGATCTGCATGAGGAATTTTAGTCGAGCAAGAAACTTGACGCTGCACACCCG |
| | | GACGCATACTGGAGAGAAGCCCTTTCAGTGTAGGATTTGTATGCGGAACTTCAG |
| | | CGACCCTTCATCTTTGAAGCGCCATCTTCGCACTCATTTGCGCGGGTCTAGCCC |
| | | CAAGAAGAAGAGAAAGGTGGGAGTCGACGGATCCAGCGGCTCCGAGACCCCAGG |
| | | CACATCTGAGAGCGCCACCCCTGAGTCCCGGACCCTGGTGACATTCAAGGACGT |
| | | GTTCGTGGACTTCACCCGGGAGGAGTGGAAGCTGCTGGACACAGCCCAGCAGAT |
| | | CGTGTACAGGAACGTGATGCTGGAGAACTATAAGAATCTGGTGTCTCTGGGCTA |
| | | CCAGCTGACAAAGCCAGATGTGATCCTGCGGCTGGAGAAGGGAGAGGAGCCCTG |
| | | GCTGGTGTAGTCTAGAAATCAACCTCTGGATTACAAAATTTGTGAAAGATTGAC |
| | | TGGTATTCTTAACTATGTTGCTCCTTTTACGCTATGTGGATACGCTGCTTTAAT |
| | | GCCTTTGTATCATGCTATTGCTTCCCGTATGGCTTTCATTTTCTCCTCCTTGTA |
| | | TAAATCCTGGTTGCTGTCTCTTTATGAGGAGTTGTGGCCCGTTGTCAGGCAACG |
| | | TGGCGTGGTGTGCACTGTGTTTGCTGACGCAACCCCCACTGGTTGGGGCATTGC |
| | | CACCACCTGTCAGCTCCTTTCCGGGACTTTCGCTTTCCCCCTCCCTATTGCCAC |
| | | GGCGGAACTCATCGCCGCCTGCCTTGCCCGCTGCTGGACAGGGGCTCGGCTGTT |
| | | GGGCACTGACAATTCCGTGGTGTTGTCGGGGAAATCATCGTCCTTTCCTTGGCT |
| | | GCTCGCCTGTGTTGCCACCTGGATTCTGCGCGGGACGTCCTTCTGCTACGTCCC |
| | | TTCGGCCCTCAATCCAGCGGACCTTCCTTCCCGCGGCCTGCTGCCGGCTCTGCG |
| | | GCCTCTTCCGCGTCTTCGCCTTCGCCCTCAGACGAGTCGGATCTCCCTTTGGGC |
| | | CGCCTCCCCGCCTGTTAATTAAAAAAAAAAAAAAAAAAAAAAAAAAAAAAAAAA |
| | | AAAAAAAAAAAAAAAAACTAGTGGCGCCTGATGCGGTATTTTCTCCTTACGCA |
| | | TCTGTGCGGTATTTCACACCGCATAATCAGCACAGTGGCGGCCCGTTAAACC |
| | | CGCTGATCAGCCTCGACTGTGCCTTCTAGTTGCCAGCCATCTGTTGTTTGCCCC |
| | | TCCCCCGTGCCTTCCTTGACCCTGGAAGGTGCCACTCCCACTGTCCTTTCCTAA |
| | | TAAAATGAGGAAATTGCATCGCATTGTCTGAGTAGGTGTCATTCTATTCTGGGG |
| | | GGTGGGGTGGGCAGGACAGCAAGGGGGAGGATTGGGAAGACAATAGCAGGCAT |
| | | GCTGGGGATGCGGTGGGCTCTATGGCTTCTGAGGCGGAAAGAACCAGCTGCATT |
| | | AATGAATCGGCCAACGCGCGGGGAGAGGCGGTTTGCGTATTGGGCGCTCTTCCG |
| | | CTTCCTCGCTCACTGACTCGCTGCGCTCGGTCGTTCGGCTGCGGCGAGCGGTAT |
| | | CAGCTCACTCAAAGGCGGTAATACGGTTATCCACAGAATCAGGGGATAACGCAG |
| | | GAAAGAACATGTGAGCAAAAGGCCAGCAAAAGGCCAGGAACCGTAAAAAGGCCG |
| | | CGTTGCTGGCGTTTTTCCATAGGCTCCGCCCCCCTGACGAGCATCACAAAAATC |
| | | GACGCTCAAGTCAGAGGTGGCGAAACCCGACAGGACTATAAAGATACCAGGCGT |

TABLE 18-continued

Sequence listing.

| SEQ | Description | Sequence |
|---|---|---|
| | | TTCCCCCTGGAAGCTCCCTCGTGCGCTCTCCTGTTCCGACCCTGCCGCTTACCG
GATACCTGTCCGCCTTTCTCCCTTCGGGAAGCGTGGCGCTTTCTCATAGCTCAC
GCTGTAGGTATCTCAGTTCGGTGTAGGTCGTTCGCTCCAAGCTGGGCTGTGTGC
ACGAACCCCCCGTTCAGCCCGACCGCTGCGCCTTATCCGGTAACTATCGTCTTG
AGTCCAACCCGGTAAGACACGACTTATCGCCACTGGCAGCAGCCACTGGTAACA
GGATTAGCAGAGCGAGGTATGTAGGCGGTGCTACAGAGTTCTTGAAGTGGTGGC
CTAACTACGGCTACACTAGAAGAACAGTATTTGGTATCTGCGCTCTGCTGAAGC
CAGTTACCTTCGGAAAAAGAGTTGGTAGCTCTTGATCCGGCAAACAAACCACCG
CTGGTAGCGGTTTTTTTGTTTGCAAGCAGCAGATTACGCGCAGAAAAAAAGGAT
CTCAAGAAGATCCTTTGATCTTTTCTACGGGGTCTGACGCTCAGTGGAACGAAA
ACTCACGTTAAGGGATTTTGGTCATGAGATTATCAAAAAGGATCTTCACCTAGA
TCCTTTTAAATTAAAAATGAAGTTTTAAATCAATCTAAAGTATATATGAGTAAA
CTTGGTCTGACAGTTACCAATGCTTAATCAGTGAGGCACCTATCTCAGCGATCT
GTCTATTTCGTTCATCCATAGTTGCCTGACTCCCCGTCGTGTAGATAACTACGA
TACGGGAGGGCTTACCATCTGGCCCCAGTGCTGCAATGATACCGCGAGACCCAC
GCTCACCGGCTCCAGATTTATCAGCAATAAACCAGCCAGCCGGAAGGGCCGAGC
GCAGAAGTGGTCCTGCAACTTTATCCGCCTCCATCCAGTCTATTAATTGTTGCC
GGGAAGCTAGAGTAAGTAGTTCGCCAGTTAATAGTTTGCGCAACGTTGTTGCCA
TTGCTACAGGCATCGTGGTGTCACGCTCGTCGTTTGGTATGGCTTCATTCAGCT
CCGGTTCCCAACGATCAAGGCGAGTTACATGATCCCCATGTTGTGCAAAAAAG
CGGTTAGCTCCTTCGGTCCTCCGATCGTTGTCAGAAGTAAGTTGGCCGCAGTGT
TATCACTCATGGTTATGGCAGCACTGCATAATTCTCTTACTGTCATGCCATCCG
TAAGATGCTTTTCTGTGACTGGTGAGTACTCAACCAAGTCATTCTGAGAATAGT
GTATGCGGCGACCGAGTTGCTCTTGCCCGGCGTCAATACGGGATAATACCGCGC
CACATAGCAGAACTTTAAAAGTGCTCATCATTGGAAAACGTTCTTCGGGGCGAA
AACTCTCAAGGATCTTACCGCTGTTGAGATCCAGTTCGATGTAACCCACTCGTG
CACCCAACTGATCTTCAGCATCTTTTACTTTCACCAGCGTTTCTGGGTGAGCAA
AAACAGGAAGGCAAATGCCGCAAAAAAGGGAATAAGGGCGACACGGAAATGTT
GAATACTCATACTCTTCCTTTTTCAATATTATTGAAGCATTTATCAGGGTTATT
GTCTCATGAGCGGATACATATTTGAATGTATTTAGAAAAATAAACAAATAGGGG
TTCCGCGCACATTTCCCCGAAAAGTGCCACCTGA |
| 1243 | Plasmid for fusion protein with mRNA0037 | CGTCGATCGACGGATCGGGAGATCTCCCGATCCCCTATGGTGCACTCTCAGTAC
AATCTGCTCTGATGCCGCATAGTTAAGCCAGTATCTGCTCCCTGCTTGTGTGTT
GGAGGTCGCTGAGTAGTGCGCGAGCAAAATTTAAGCTACAACAAGGCAAGGCTT
GACCGACAATTGCATGAAGAATCTGCTTAGGGTTAGGCGTTTTGCGCTGCTTCG
CGATGTACGGGCCAGATATACGCGTTGACATTGATTATTGACTAGTTATTAATA
GTAATCAATTACGGGGTCATTAGTTCATAGCCCATATATGGAGTTCCGCGTTAC
ATAACTTACGGTAAATGGCCCGCCTGGCTGACCGCCAACGACCCCCGCCCATT
GACGTCAATAATGACGTATGTTCCCATAGTAACGCCAATAGGGACTTTCCATTG
ACGTCAATGGGTGGAGTATTTACGGTAAACTGCCCACTTGGCAGTACATCAAGT
GTATCATATGCCAAGTACGCCCCCTATTGACGTCAATGACGGTAAATGGCCCGC
CTGGCATTATGCCCAGTACATGACCTTATGGGACTTTCCTACTTGGCAGTACAT
CTACGTATTAGTCATCGCTATTACCATGGTGATGCGGTTTTGGCAGTACATCAA
TGGGCGTGGATAGCGGTTTGACTCACGGGGATTTCCAAGTCTCCACCCCATTGA
CGTCAATGGGAGTTTGTTTTGGCACCAAAATCAACGGGACTTTCCAAAATGTCG
TAACAACTCCGCCCCATTGACGCAAATGGGCGGTAGGCGTGTACGGTGGGAGGT
CTATATAAGCAGAGCTCTCTGGCTAACTAGAGAACCCACTGCTTACTGGCTTAT
CGAAATTAATACGACTCACTATAAGGAGACCCAAGCTACCGGTGCCACCATGTA
CCCATACGATGTTCCAGATTACGCTTCGCCGAAGAAAAAGCGCAAGGTCAATCA
CGATCAGGAGTTCGACCCCCCTAAGGTGTACCCACCAGTGCCTGCAGAGAAGAG
GAAGCCAATCCGGGTGCTGAGCCTGTTTGATGGCATCGCCACCGGCCTGCTGGT
GCTGAAGGATCTGGGCATCCAGGTGGACCGGTACATCGCCTCCGAGGTGTGCGA
GGATTCTATCACCGTGGGCGCGCCACCAGGGCAAGATCATGTATGTGGG
CGACGTGCGGTCCGTGACACAGAAGCACATCCAGGAGTGGGGCCCATTCGATCT
GGTGATCGGCGGCAGCCCCTGTAATGACCTGTCCATCGTGAACCCTGCAAGGAA
GGGACTGTACGAGGGAACCGGCCGGCTGTTCTTTGAGTTTTATAGACTGCTGCA
CGACGCCAGGCCTAAGGAGGGCGACGATAGACCATTCTTTTGGCTGTTCGAGAA
TGTGGTGGCTATGGGCGTGAGCGATAAGAGGGACATCTCCAGGTTTCTGGAGTC
TAACCCCGTGATGATCGATGCAAAGGAGGTGTCCGCCGCACACAGAGCCAGGTA
TTTCTGGGGCAATCTGCCAGGAATGAACAGGCCACTGGCAAGCACCGTGAATGA
CAAGCTGGAGCTGCAGGAGTGCCTGGAGCACGGAAGGATCGCCAAGTTTTCCAA
GGTGCGCACAATCACCACACGGAGCAATTCCATCAAGCAGGGCAAGGATCAGCA
CTTCCCCGTGTTCATGAACGAGAAGGAGGACATCCTGTGGTGTACCGAGATGGA
GAGAGTGTTCGGCTTTCCAGTGCACTACACAGACGTGTCTAACATGAGCAGGCT
GGCAAGGCAGCGGCTGCTGGGCAGATCTTGGAGCGTGCCCGTGATCAGGCACCT
GTTCGCCCCTCTGAAGGAGTATTTTGCCTGCGTGAGCAGCGGCAACTCCAATGC
CAACAGCCGGGGCCCCTCTTTCAGCTCCGGATTGGTGCCTCTGAGCCTGAGGGG
CTCCCACATGGCAGCAATCCCCGCCTGGACCCCGAGGCCGAGCCTAGCATGGA
CGTGATCCTGGTGGGCTCTAGCGAGCTGTCCTCTAGCGTGTCTCCAGGAACCGG
AAGGGATCTGATCGCATACGAGGTGAAGGCCAATCAGCGGAACATCGAGGACAT
CTGTATCTGCTGTGGCAGCCTGCAGGTGCACACAGCACCCACTGTTCGAGGG
AGGAATCTGCGCACCCTGTAAGGATAAGTTCCTGGACGCCCTGTTTCTGTACGA
CGATGACGGCTACCAGTCCTATTGCTCTATCTGCTGTTCCGGCGAGACCCTGCT
GATCTGCGGCAATTCCAGATTGTACAAGGTGCTATTGTTTTGAGTGCGTGGACTC
TCTGGTGGGACCAGGCACCAGCGGAAAGGTGCACGCCATGTCCAACTGGGTGTG |

TABLE 18-continued

Sequence listing.

| SEQ | Description | Sequence |
|---|---|---|
| | | CTACCTGTGCCTGCCATCCTCTCGCAGCGGACTGCTGCAGCGGAGAAGGAAGTG
GAGATCCCAGCTGAAGGCCTTCTATGATAGGGAGTCTGAGAACCCCCTGGAGAT
GTTTGAGACCGTGCCAGTGTGGCGCCGGCAGCCCGTGAGGGTGCTGAGCCTGTT
CGAGGATATCAAGAAGGAGCTGACATCCCTGGGCTTTCTGGAGTCCGGCTCTGA
CCCCGGACAGCTGAAGCACGTGGTGGATGTGACCGACACAGTGCGGAAGGATGT
GGAGGAGTGGGGCCCTTTCGACCTGGTGTACGGAGCAACCCCTCCACTGGGACA
CACATGCGACAGACCCCCTTCTTGGTACCTGTTCCAGTTTCACCGCCTGCTGCA
GTATGCAAGGCCAAAGCCAGGCAGCCCTAGACCATTCTTTTGGATGTTCGTGGA
TAATCTGGTGCTGAACAAGGAGGATCTGGACGTGGCCAGCAGGTTTCTGGAGAT
GGAGCCAGTGACCATCCCAGACGTGCACGGCGGCTCCCTGCAGAATGCCGTGCG
CGTGTGGTCTAACATCCCTGCCATCAGAAGCAGGCACTGGGCACTGGTGAGCGA
GGAGGAGCTGTCCCTGCTGGCCCAGAATAAGCAGAGCAGCAAGCTGGCCGCCAA
GTGGCCTACAAAGCTGGTGAAGAACTGCTTCCTGCCACTGCGGGAGTACTTCAA
GTATTTTTCCACCGAGCTGACATCTAGCCTGGGAGGACCCTCCTCTGGCGCCCC
ACCACCTAGCGGCGGCTCCCCTGCCGGCTCTCCAACCAGCACAGAGGAGGGCAC
CAGCGAGTCCGCCACACCAGAGTCTGGACCTGGCACCAGCACAGAGCCATCCGA
GGGCTCTGCCCCAGGCTCTCCTGCAGGCAGCCCTACCTCCACCGAAGAGGGCAC
CAGCACAGAGCCTTCTGAGGGCAGCGCCCCAGGCACCTCTACAGAGCCAAGCGA
GCTCGAGTCCCGGCCAGGGGAACGGCCCTTCCAGTGTCGGATCTGCATGAGAAA
CTTTTCAAGAGTGGATCATCTCCATCGACACCTCCGGACCCACACTGGAGAGAA
ACCCTTTCAGTGCAGGATATGTATGCGGAATTTTTCCCGGAGGGAACATTTGTC
CGGACATCTCAAGACACATACCGGGGAGGCGGTAGTCAGAAGCCTTTCCAATG
CCGGATTTGCATGAGGAACTTCTCCCAAAGTTCCAGCCTCGTCCGCCATCTTCG
CACACATACAGGCGAGAAGCCATTCCAGTGTAGGATCTGCATGCGCAATTTTAG
CCGCAAGGAGCGATTGGCAACCCACCTCAAGACGCATACAGGTAGTCAGAAGCC
TTTTCAGTGCAGGATCTGCATGAGGAATTTTAGTGTCGCACATAACCTCACAAG
GCATCTGCGCACGCATACTGGAGAGAAGCCCTTTCAGTGTAGGATTTGTATGCG
GAACTTCAGCATTAGTCATAACCTGGCAAGGCATCTCAAAACTCATTTGCGCGG
GTCTAGCCCCAAGAAGAAGAGAAAGGTGGGAGTCGACGGATCCAGCGGCTCCGA
GACCCCAGGCACATCTGAGAGCGCCACCCCTGAGTCCCGGACCCTGGTGACATT
CAAGGACGTGTTCGTGGACTTCACCCGGGAGGAGTGGAAGCTGCTGGACACAGC
CCAGCAGATCGTGTACAGGAACGTGATGCTGGAGAACTATAAGAATCTGGTGTC
TCTGGGCTACCAGCTGACAAAGCCAGATGTGATCCTGCGGCTGGAGAAGGGAGA
GGAGCCCTGGCTGGTAGTCTAGAAATCAACCTCTGGATTACAAAATTTGTGA
AAGATTGACTGGTATTCTTAACTATGTTGCTCCTTTTACGCTATGTGGATACGC
TGCTTTAATGCCTTTGTATCATGCTATTGCTTCCCGTATGGCTTTCATTTTCTC
CTCCTTGTATAAATCCTGGTTGCTGTCTCTTTATGAGGAGTTGTGGCCCGTTGT
CAGGCAACGTGGCGTGGTGTGCACTGTGTTTGCTGACGCAACCCCCACTGGTTG
GGGCATTGCCACCACCTGTCAGCTCCTTTCCGGGACTTTCGCTTTCCCCCTCCC
TATTGCCACGGCGGAACTCATCGCCGCCTGCCTTGCCCGCTGCTGGACAGGGGC
TCGGCTGTTGGGCACTGACAATTCCGTGGTGTTGTCGGGGAAATCATCGTCCTT
TCCTTGGCTGCTCGCCTGTGTTGCCACCTGGATTCTGCGCGGGACGTCCTTCTG
CTACGTCCCTTCGGCCCTCAATCCAGCGGACCTTCCTTCCCGCGGCCTGCTGCC
GGCTCTGCGGCCTCTTCCGCGTCTTCGCCTTCGCCCTCAGACGAGTCGGATCTC
CCTTTGGGCCGCCTCCCCGCCTGTTAATTAAAAAAAAAAAAAAAAAAAAAAAAA
AAAAAAAAAAAAAAAAAAAAAAACTAGTGGCGCCTGATGCGGTATTTTCT
CCTTACGCATCTGTGCGGTATTTCACACCGCATAATCCAGCACAGTGGCGGCCC
GTTTAAACCCGCTGATCAGCCTCGACTGTGCCTTCTAGTTGCCAGCCATCTGTT
GTTTGCCCCTCCCCCGTGCCTTCCTTGACCCTGGAAGGTGCCACTCCCACTGTC
CTTTCCTAATAAAATGAGGAAATTGCATCGCATTGTCTGAGTAGGTGTCATTCT
ATTCTGGGGGGTGGGGTGGGCAGGACAGCAAGGGGGAGGATTGGGAAGACAAT
AGCAGGCATGCTGGGGATGCGGTGGGCTCTATGGCTTCTGAGGCGGAAAGAACC
AGCTGCATTAATGAATCGGCCAACGCGCGGGGAGAGGCGGTTTGCGTATTGGGC
GCTCTTCCGCTTCCTCGCTCACTGACTCGCTGCGCTCGGTCGTTCGGCTGCGGC
GAGCGGTATCAGCTCACTCAAAGGCGGTAATACGGTTATCCACAGAATCAGGGG
ATAACGCAGGAAAGAACATGTGAGCAAAAGGCCAGCAAAAGGCCAGGAACCGTA
AAAAGGCCGCGTTGCTGGCGTTTTTCCATAGGCTCCGCCCCCCTGACGAGCATC
ACAAAAATCGACGCTCAAGTCAGAGGTGGCGAAACCCGACAGGACTATAAAGAT
ACCAGGCGTTTCCCCCTGGAAGCTCCCTCGTGCGCTCTCCTGTTCCGACCCTGC
CGCTTACCGGATACCTGTCCGCCTTTCTCCCTTCGGGAAGCGTGGCGCTTTCTC
ATAGCTCACGCTGTAGGTATCTCAGTTCGGTGTAGGTCGTTCGCTCCAAGCTGG
GCTGTGTGCACGAACCCCCCGTTCAGCCCGACCGCTGCGCCTTATCCGGTAACT
ATCGTCTTGAGTCCAACCCGGTAAGACACGACTTATCGCCACTGGCAGCAGCCA
CTGGTAACAGGATTAGCAGAGCGAGGTATGTAGGCGGTGCTACAGAGTTCTTGA
AGTGGTGGCCTAACTACGGCTACACTAGAAGAACAGTATTTGGTATCTGCGCTC
TGCTGAAGCCAGTTACCTTCGGAAAAAGAGTTGGTAGCTCTTGATCCGGCAAAC
AAACCACCGCTGGTAGCGGTTTTTTTGTTTGCAAGCAGCAGATTACGCGCAGAA
AAAAAGGATCTCAAGAAGATCCTTTGATCTTTTCTACGGGGTCTGACGCTCAGT
GGAACGAAAACTCACGTTAAGGGATTTTGGTCATGAGATTATCAAAAGGATCT
TCACCTAGATCCTTTTAAATTAAAAATGAAGTTTTAAATCAATCTAAAGTATAT
ATGAGTAAACTTGGTCTGACAGTTACCAATGCTTAATCAGTGAGGCACCTATCT
CAGCGATCTGTCTATTTCGTTCATCCATAGTTGCCTGACTCCCCGTCGTGTAGA
TAACTACGATACGGGAGGGCTTACCATCTGGCCCCAGTGCTGCAATGATACCGC
GAGACCCACGCTCACCGGCTCCAGATTTATCAGCAATAAACCAGCCAGCCGGAA
GGGCCGAGCGCAGAAGTGGTCCTGCAACTTTATCCGCCTCCATCCAGTCTATTA
ATTGTTGCCGGGAAGCTAGAGTAAGTAGTTCGCCAGTTAATAGTTTGCGCAACG |

TABLE 18-continued

Sequence listing.

| SEQ | Description | Sequence |
|---|---|---|
| | | TTGTTGCCATTGCTACAGGCATCGTGGTGTCACGCTCGTCGTTTGGTATGGCTT<br>CATTCAGCTCCGGTTCCCAACGATCAAGGCGAGTTACATGATCCCCCATGTTGT<br>GCAAAAAAGCGGTTAGCTCCTTCGGTCCTCCGATCGTTGTCAGAAGTAAGTTGG<br>CCGCAGTGTTATCACTCATGGTTATGGCAGCACTGCATAATTCTCTTACTGTCA<br>TGCCATCCGTAAGATGCTTTTCTGTGACTGGTGAGTACTCAACCAAGTCATTCT<br>GAGAATAGTGTATGCGGCGACCGAGTTGCTCTTGCCCGGCGTCAATACGGGATA<br>ATACCGCGCCACATAGCAGAACTTTAAAAGTGCTCATCATTGGAAAACGTTCTT<br>CGGGGCGAAAACTCTCAAGGATCTTACCGCTGTTGAGATCCAGTTCGATGTAAC<br>CCACTCGTGCACCCAACTGATCTTCAGCATCTTTTACTTTCACCAGCGTTTCTG<br>GGTGAGCAAAAACAGGAAGGCAAAATGCCGCAAAAAAGGGAATAAGGGCGACAC<br>GGAAATGTTGAATACTCATACTCTTCCTTTTTCAATATTATTGAAGCATTTATC<br>AGGGTTATTGTCTCATGAGCGGATACATATTTGAATGTATTTAGAAAAATAAAC<br>AAATAGGGGTTCCGCGCACATTTCCCCGAAAAGTGCCACCTGA |
| 1244 | Plasmid for fusion<br>protein with<br>mRNA0038 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG<br>CGATGTACGGGCCAGATATACGCGTTGACATTGATTATTGACTAGTTATTAATA<br>GTAATCAATTACGGGGTCATTAGTTCATAGCCCATATATGGAGTTCCGCGTTAC<br>ATAACTTACGGTAAATGGCCCGCCTGGCTGACCGCCCAACGACCCCCGCCCATT<br>GACGTCAATAATGACGTATGTTCCCATAGTAACGCCAATAGGGACTTTCCATTG<br>ACGTCAATGGGTGGAGTATTTACGGTAAACTGCCCACTTGGCAGTACATCAAGT<br>GTATCATATGCCAAGTACGCCCCCTATTGACGTCAATGACGGTAAATGGCCCGC<br>CTGGCATTATGCCCAGTACATGACCTTATGGGACTTTCCTACTTGGCAGTACAT<br>CTACGTATTAGTCATCGCTATTACCATGGTGATGCGGTTTTGGCAGTACATCAA<br>TGGGCGTGGATAGCGGTTTGACTCACGGGGATTTCCAAGTCTCCACCCCATTGA<br>CGTCAATGGGAGTTTGTTTTGGCACCAAAATCAACGGGACTTTCCAAAATGTCG<br>TAACAACTCCGCCCCATTGACGCAAATGGGCGGTAGGCGTGTACGGTGGGAGGT<br>CTATATAAGCAGAGCTCTCTGGCTAACTAGAGAACCCACTGCTTACTGGCTTAT<br>CGAAATTAATACGACTCACTATAAGGAGACCCAAGCTACCGGTGCCACCATGTA<br>CCCATACGATGTTCCAGATTACGCTTCGCCGAAGAAAAAGCGCAAGGTCAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA<br>TGTGGTGGCTATGGGCGTGAGCGATAAGAGGGACATCTCCAGGTTTCTGGAGTC<br>TAACCCCGTGATGATCGATGCAAAGGAGGTGTCCGCCGCACACAGAGCCAGGTA<br>TTTTCTGGGGCAATCTGCCAGGAATGAACAGGCCACTGGCAAGCACCGTGAATGA<br>CAAGCTGGAGCTGCAGGAGTGCCTGGAGCACGGAAGGATCGCCAAGTTTTCCAA<br>GGTGCGCACAATCACCACACGGAGCAATTCCATCAAGCAGGGCAAGGATCAGCA<br>CTTCCCCGTGTTCATGAACGAGAAGGAGGACATCCTGTGGTGTACCGAGATGGA<br>GAGAGTGTTCGGCTTTCCAGTGCACTACACAGACGTGTCTAACATGAGCAGGCT<br>GGCAAGGCAGCGGCTGCTGGGCAGATCTTGGAGCGTGCCCGTGATCAGGCACCT<br>GTTCGCCCCTCTGAAGGAGTATTTTGCCTGCGTGAGCAGCGGCAACTCCAATGC<br>CAACAGCCGGGGCCCCTCTTTCAGCTCCGGATTGGTGCCTCTGAGCCTGAGGGG<br>CTCCCACATGGCAGCAATCCCCGCCCTGGACCCCGAGGCCGAGCCTAGCATGGA<br>CGTGATCCTGGTGGGCTCTAGCGAGCTGTCCTCTAGCGTGTCTCCAGGAACCGG<br>AAGGGATCTGATCGCATACGAGGTGAAGGCCAATCAGCGGAACATCGAGGACAT<br>CTGTATCTGCTGTGTGGCAGCCTGCAGGTGCACACACAGCACCCACTGTTCGAGGG<br>AGGAATCTGCGCACCCTGTAAGGATAAGTTCCTGGACGCCCTGTTTCTGTACGA<br>CGATGACGGCTACCAGTCCTATTGCTCTATCTGCTGTTCCGGCGAGACCCTGCT<br>GATCTGCGGCAATCCAGATTGTACAAGGTGCTATTGTTTTGAGTGCGTGGACTC<br>TCTGGTGGGACCAGGCACCAGCGGAAAGGTGCACGCCATGTCCAACTGGGTGTG<br>CTACCTGTGCCTGCCATCCTCTCGCAGCGGACTGCTGCAGCGGAGAAGGAAGTG<br>GAGATCCCAGCTGAAGGCCTTCTATGATAGGGAGTCTGAGAACCCCCTGGAGAT<br>GTTTGAGACCGTGCCAGTGTGGCGCCGGCAGCCCGTGAGGGTGCTGAGCCTGTT<br>CGAGGATATCAAGAAGGAGCTGACATCCCTGGGCTTTCTGGAGTCCGGCTCTGA<br>CCCCGGACAGCTGAAGCACGTGGTGGATGTGACCGACACAGTGCGGAAGGATGT<br>GGAGGAGTGGGGCCCTTTCGACCTGGTGTACGGAGCAACCCCTCCACTGGGACA<br>CACATGCGACAGACCCCCTTCTTGGTACCTGTTCCAGTTTTCACCGCCTGCTGCA<br>GTATGCAAGGCCAAAGCCAGGCAGCCCTAGACCATTCTTTTGGATGTTCGTGGA<br>TAATCTGGTGCTGAACAAGGAGGATCTGGACGTGGCCAGCAGGTTTCTGGAGAT<br>GGAGCCAGTGACCATCCCAGACGTGCACGGCGGCTCCCTGCAGAATGCCGTGCG<br>CGTGTGGTCTAACATCCCTGCCATCAGAAGCAGGCACTGGGCACTGGTGAGCGA<br>GGAGGAGCTGTCCCTGCTGGCCCAGAATAAGCAGAGCAGCAAGCTGGCCGCCAA<br>GTGGCCTACAAAGCTGGTGAAGAACTGCTTCCTGCCACTGCGGGAGTACTTCAA<br>GTATTTTTCCACCGAGCTGACATCTAGCCTGGGAGGACCCTCCTCTGGCGCCCC<br>ACCACCTAGCGGCGGCTCCCCTGCCGGCTCTCCAACCAGCACAGAGGAGGGCAC<br>CAGCGAGTCCGCCACACCAGAGTCTGGACCTGGCACCAGCACAGAGCCATCCGA<br>GGGCTCTGCCCCAGGCTCTCCTGCAGGCAGCCCTACCTCCACCGAAGAGGGCAC<br>CAGCACAGAGCCTTCTGAGGGCAGCGCCCCAGGCACCTCTACAGAGCCAAGCGA |

TABLE 18-continued

Sequence listing.

| SEQ | Description | Sequence |
|---|---|---|
| | | GCTCGAGTCCCGGCCAGGGGAACGGCCCTTCCAGTGTCGGATCTGCATGAGAAA<br>CTTTTCACGCAAGCACCACCTTGGGAGACATACCAGAACCCACACTGGAGAGAA<br>ACCCTTTCAGTGCAGGATATGTATGCGGAATTTTTCCCGACGGGAACACCTCAC<br>GATTCATTTGCGGACACATACCGGGGGAGGCGGTAGTCAGAAGCCTTTCCAATG<br>CCGGATTTGCATGAGGAACTTCTCCCAGAGCTCATCTCTCGTGCGGCACCTGCG<br>GACACATACAGGCGAGAAGCCATTCCAGTGTAGGATCTGCATGCGCAATTTTAG<br>CCGGAAGGAGCGATTGGCGACGCACCTGAAAACGCATACAGGTAGTCAGAAGCC<br>TTTTCAGTGCAGGATCTGCATGAGGAATTTTAGTGTAGCCCACAACCTGACTAG<br>GCATTTGAGGACGCATACTGGAGAGAAGCCCTTTCAGTGTAGGATTTGTATGCG<br>GAACTTCAGCATTTCTCACAATCTCGCGCGACATTTGAAAACTCATTTGCGCGG<br>GTCTAGCCCCAAGAAGAAGAGAAAGGTGGGAGTCGACGGATCCAGCGGCTCCGA<br>GACCCCAGGCACATCTGAGAGCGCCACCCCTGAGTCCCGGACCCTGGTGACATT<br>CAAGGACGTGTTCGTGGACTTCACCCGGGAGGAGTGGAAGCTGCTGGACACAGC<br>CCAGCAGATCGTGTACAGGAACGTGATGCTGGAGAACTATAAGAATCTGGTGTC<br>TCTGGGCTACCAGCTGACAAAGCCAGATGTGATCCTGCGGCTGGAGAAGGGAGA<br>GGAGCCCTGGCTGGTGTAGTCTAGAAATCAACCTCTGGATTACAAAATTTGTGA<br>AAGATTGACTGGTATTCTTAACTATGTTGCTCCTTTTACGCTATGTGGATACGC<br>TGCTTTAATGCCTTTGTATCATGCTATTGCTTCCCGTATGGCTTTCATTTTCTC<br>CTCCTTGTATAAATCCTGGTTGCTGTCTCTTTATGAGGAGTTGTGGCCCGTTGT<br>CAGGCAACGTGGCGTGGTGTGCACTGTGTTTGCTGACGCAACCCCCACTGGTTG<br>GGGCATTGCCACCACCTGTCAGCTCCTTTCCGGGACTTTCGCTTTCCCCCTCCC<br>TATTGCCACGGCGGAACTCATCGCCGCCTGCCTTGCCCGCTGCTGGACAGGGGC<br>TCGGCTGTTGGGCACTGACAATTCCGTGGTGTTGTCGGGGAAATCATCGTCCTT<br>TCCTTGGCTGCTCGCCTGTGTTGCCACCTGGATTCTGCGCGGGACGTCCTTCTG<br>CTACGTCCCTTCGGCCCTCAATCCAGCGGACCTTCCTTCCCGCGGCCTGCTGCC<br>GGCTCTGCGGCCTCTTCCGCGTCTTCGCCTTCGCCCTCAGACGAGTCGGATCTC<br>CCTTTGGGCCGCCTCCCCGCCTGTTAATTAAAAAAAAAAAAAAAAAAAAAAAAA<br>AAAAAAAAAAAAAAAAAAAAAAAAAACTAGTGGCGCCTGATGCGGTATTTTCT<br>CCTTACGCATCTGTGCGGTATTTCACACCGCATAATCCAGCACAGTGGCGGCCC<br>GTTTAAACCCGCTGATCAGCCTCGACTGTGCCTTCTAGTTGCCAGCCATCTGTT<br>GTTTGCCCCTCCCCCGTGCCTTCCTTGACCCTGGAAGGTGCCACTCCCACTGTC<br>CTTTCCTAATAAAATGAGGAAATTGCATCGCATTGTCTGAGTAGGTGTCATTCT<br>ATTCTGGGGGGTGGGGTGGGGCAGGACAGCAAGGGGGAGGATTGGGAAGACAAT<br>AGCAGGCATGCTGGGGATGCGGTGGGCTCTATGGCTTCTGAGGCGGAAAGAACC<br>AGCTGCATTAATGAATCGGCCAACGCGCGGGGAGAGGCGGTTTGCGTATTGGGC<br>GCTCTTCCGCTTCCTCGCTCACTGACTCGCTGCGCTCGGTCGTTCGGCTGCGGC<br>GAGCGGTATCAGCTCACTCAAAGGCGGTAATACGGTTATCCACAGAATCAGGGG<br>ATAACGCAGGAAAGAACATGTGAGCAAAAGGCCAGCAAAAGGCCAGGAACCGTA<br>AAAAGGCCGCGTTGCTGGCGTTTTTCCATAGGCTCCGCCCCCCTGACGAGCATC<br>ACAAAAATCGACGCTCAAGTCAGAGGTGGCGAAACCCGACAGGACTATAAAGAT<br>ACCAGGCGTTTCCCCCTGGAAGCTCCCTCGTGCGCTCTCCTGTTCCGACCCTGC<br>CGCTTACCGGATACCTGTCCGCCTTTCTCCCTTCGGGAAGCGTGGCGCTTTCTC<br>ATAGCTCACGCTGTAGGTATCTCAGTTCGGTGTAGGTCGTTCGCTCCAAGCTGG<br>GCTGTGTGCACGAACCCCCCGTTCAGCCCGACCGCTGCGCCTTATCCGGTAACT<br>ATCGTCTTGAGTCCAACCCGGTAAGACACGACTTATCGCCACTGGCAGCAGCCA<br>CTGGTAACAGGATTAGCAGAGCGAGGTATGTAGGCGGTGCTACAGAGTTCTTGA<br>AGTGGTGGCCTAACTACGGCTACACTAGAAGAACAGTATTTGGTATCTGCGCTC<br>TGCTGAAGCCAGTTACCTTCGGAAAAAGAGTTGGTAGCTCTTGATCCGGCAAAC<br>AAACCACCGCTGGTAGCGGTTTTTTTGTTTGCAAGCAGCAGATTACGCGCAGAA<br>AAAAAGGATCTCAAGAAGATCCTTTGATCTTTTCTACGGGGTCTGACGCTCAGT<br>GGAACGAAAACTCACGTTAAGGGATTTTGGTCATGAGATTATCAAAAAGGATCT<br>TCACCTAGATCCTTTTAAATTAAAAATGAAGTTTTAAATCAATCTAAAGTATAT<br>ATGAGTAAACTTGGTCTGACAGTTACCAATGCTTAATCAGTGAGGCACCTATCT<br>CAGCGATCTGTCTATTTCGTTCATCCATAGTTGCCTGACTCCCCGTCGTGTAGA<br>TAACTACGATACGGGAGGGCTTACCATCTGGCCCCAGTGCTGCAATGATACCGC<br>GAGACCCACGCTCACCGGCTCCAGATTTATCAGCAATAAACCAGCCAGCCGGAA<br>GGGCCGAGCGCAGAAGTGGTCCTGCAACTTTATCCGCCTCCATCCAGTCTATTA<br>ATTGTTGCCGGGAAGCTAGAGTAAGTAGTTCGCCAGTTAATAGTTTGCGCAACG<br>TTGTTGCCATTGCTACAGGCATCGTGGTGTCACGCTCGTCGTTTGGTATGGCTT<br>CATTCAGCTCCGGTTCCCAACGATCAAGGCGAGTTACATGATCCCCATGTTGT<br>GCAAAAAAGCGGTTAGCTCCTTCGGTCCTCCGATCGTTGTCAGAAGTAAGTTGG<br>CCGCAGTGTTATCACTCATGGTTATGGCAGCACTGCATAATTCTCTTACTGTCA<br>TGCCATCCGTAAGATGCTTTTCTGTGACTGGTGAGTACTCAACCAAGTCATTCT<br>GAGAATAGTGTATGCGGCGACCGAGTTGCTCTTGCCCGGCGTCAATACGGGATA<br>ATACCGCGCCACATAGCAGAACTTTAAAAGTGCTCATCATTGGAAAACGTTCTT<br>CGGGGCGAAAACTCTCAAGGATCTTACCGCTGTTGAGATCCAGTTCGATGTAAC<br>CCACTCGTGCACCCAACTGATCTTCAGCATCTTTTACTTTCACCAGCGTTTCTG<br>GGTGAGCAAAAACAGGAAGGCAAAATGCCGCAAAAAAGGGAATAAGGGCGACAC<br>GGAAATGTTGAATACTCATACTCTTCCTTTTTCAATATTATTGAAGCATTTATC<br>AGGGTTATTGTCTCATGAGCGGATACATATTTGAATGTATTTAGAAAAATAAAC<br>AAATAGGGGTTCCGCGCACATTTCCCCGAAAAGTGCCACCTGA |
| 1245 | Plasmid for fusion protein with mRNA0039 | CGTCGATCGACGGATCGGGAGATCTCCCGATCCCCTATGGTGCACTCTCAGTAC<br>AATCTGCTCTGATGCCGCATAGTTAAGCCAGTATCTGCTCCCTGCTTGTGTGTT<br>GGAGGTCGCTGAGTAGTGCGCGAGCAAAATTTAAGCTACAACAAGGCAAGGCTT<br>GACCGACAATTGCATGAAGAATCTGCTTAGGGTTAGGCGTTTTGCGCTGCTTCG |

TABLE 18-continued

Sequence listing.

| SEQ | Description | Sequence |
|---|---|---|
| | | CGATGTACGGGCCAGATATACGCGTTGACATTGATTATTGACTAGTTATTAATA
GTAATCAATTACGGGGTCATTAGTTCATAGCCCATATATGGAGTTCCGCGTTAC
ATAACTTACGGTAAATGGCCCGCCTGGCTGACCGCCCAACGACCCCCGCCCATT
GACGTCAATAATGACGTATGTTCCCATAGTAACGCCAATAGGGACTTTCCATTG
ACGTCAATGGGTGGAGTATTTACGGTAAACTGCCCACTTGGCAGTACATCAAGT
GTATCATATGCCAAGTACGCCCCCTATTGACGTCAATGACGGTAAATGGCCCGC
CTGGCATTATGCCCAGTACATGACCTTATGGGACTTTCCTACTTGGCAGTACAT
CTACGTATTAGTCATCGCTATTACCATGGTGATGCGGTTTTGGCAGTACATCAA
TGGGCGTGGATAGCGGTTTGACTCACGGGGATTTCCAAGTCTCCACCCCATTGA
CGTCAATGGGAGTTTGTTTTGGCACCAAAATCAACGGGACTTTCCAAAATGTCG
TAACAACTCCGCCCCATTGACGCAAATGGGCGGTAGGCGTGTACGGTGGGAGGT
CTATATAAGCAGAGCTCTCTGGCTAACTAGAGAACCCACTGCTTACTGGCTTAT
CGAAATTAATACGACTCACTATAAGGAGACCCAAGCTACCGGTGCCACCATGTA
CCCATACGATGTTCCAGATTACGCTTCGCCGAAGAAAAAGCGCAAGGTCAATCA
CGATCAGGAGTTCGACCCCCCTAAGGTGTACCCACCAGTGCCTGCAGAGAAGAG
GAAGCCAATCCGGGTGCTGAGCCTGTTTGATGGCATCGCCACCGGCCTGCTGGT
GCTGAAGGATCTGGGCATCCAGGTGGACCGGTACATCGCCTCCGAGGTGTGCGA
GGATTCTATCACCGTGGGCATGGTGCGCCACCAGGGCAAGATCATGTATGTGGG
CGACGTGCGGTCCGTGACACAGAAGCACATCCAGGAGTGGGGCCCATTCGATCT
GGTGATCGGCGGCAGCCCCTGTAATGACCTGTCCATCGTGAACCCTGCAAGGAA
GGGACTGTACGAGGGAACCGGCCGGCTGTTCTTTGAGTTTTATAGACTGCTGCA
CGACGCCAGGCCTAAGGAGGGCGACGATAGACCATTCTTTTGGCTGTTCGAGAA
TGTGGTGGCTATGGGCGTGAGCGATAAGAGGGACATCTCCAGGTTTCTGGAGTC
TAACCCCGTGATGATCGATGCAAAGGAGGTGTCCGCCGCACACAGAGCCAGGTA
TTTCTGGGGCAATCTGCCAGGAATGAACAGGCCACTGGCAAGCACCGTGAATGA
CAAGCTGGAGCTGCAGGAGTGCCTGGAGCACGGAAGGATCGCCAAGTTTTCCAA
GGTGCGCACAATCACCACACGGAGCAATTCCATCAAGCAGGGCAAGGATCAGCA
CTTCCCCGTGTTCATGAACGAGAAGGAGGACATCCTGTGGTGTACCGAGATGGA
GAGAGTGTTCGGCTTTCAGTGCACTACACAGACGTGTCTAACATGAGCAGGCT
GGCAAGGCAGCGGCTGCTGGGCAGATCTTGGAGCGTGCCCGTGATCAGGCACCT
GTTCGCCCCTCTGAAGGAGTATTTTGCCTGCGTGAGCAGCGGCAACTCCAATGC
CAACAGCCGGGGCCCCTCTTTCAGCTCCGGATTGGTGCCTCTGAGCCTGAGGGG
CTCCCACATGGCAGCAATCCCCGCCTGGACCCCGAGGCCGAGCCTAGCATGGA
CGTGATCCTGGTGGGCTCTAGCGAGCTGTCCTCTAGCGTGTCTCCAGGAACCGG
AAGGGATCTGATCGCATACGAGGTGAAGGCCAATCAGCGGAACATCGAGGACAT
CTGTATCTGCTGTGGCAGCCTGCAGGTGCACACACAGCACCCACTGTTCGAGGG
AGGAATCTGCGCACCCTGTAAGGATAAGTTCCTGGACGCCCTGTTTCTGTACGA
CGATGACGGCTACCAGTCCTATTGCTCTATCTGCTGTTCCGGCGAGACCCTGCT
GATCTGCGGCAATCCAGATTGTACAAGGTGCTATTGTTTTGAGTGCGTGGACTC
TCTGGTGGGACCAGGCACCAGCGGAAAGGTGCACGCCATGTCCAACTGGGTGTG
CTACCTGTGCCTGCCATCCTCTCGCAGCGGACTGCTGCAGCGGAGAAGGAAGTG
GAGATCCCAGCTGAAGGCCTTCTATGATAGGGAGTCTGAGAACCCCCTGGAGAT
GTTTGAGACCGTGCCAGTGTGGCGCCGGCAGCCCGTGAGGGTGCTGAGCCTGTT
CGAGGATATCAAGAAGGAGCTGACATCCCTGGGCTTTCTGGAGTCCGGCTCTGA
CCCCGGACAGCTGAAGCACGTGGTGGATGTGACCGACACAGTCGGAAGGATGT
GGAGGAGTGGGGCCCTTTCGACCTGGTGTACGGAGCAACCCCTCCACTGGGACA
CACATGCGACAGACCCCCTTCTTGGTACCTGTTCCAGTTTCACCGCCTGCTGCA
GTATGCAAGGCCAAAGCCAGGCAGCCCTAGACCATTCTTTTGGATGTTCGTGGA
TAATCTGGTGCTGAACAAGGAGGATCTGGACGTGGCCAGCAGGTTTCTGGAGAT
GGAGCCAGTGACCATCCCAGACGTGCACGGCGGCTCCCTGCAGAATGCCGTGCG
CGTGTGGTCTAACATCCCTGCCATCAGAAGCAGGCACTGGGCACTGGTGAGCGA
GGAGGAGCTGTCCCTGCTGGCCCAGAATAAGCAGAGCAGCAAGCTGGCCGCCAA
GTGGCCTACAAAGCTGGTGAAGAACTGCTTCCTGCCACTGCGGGAGTACTTCAA
GTATTTTTCCACCGAGCTGACATCTAGCCTGGGAGGACCCTCCTCTGGCGCCCC
ACCACTTAGCGGCGGCTCCCCTGCCGGCTCTCCAACCAGCACAGAGGAGGGCAC
CAGCGAGTCCGCCACACCAGAGTCTGGACCTGGCACCAGCACAGAGCCATCCGA
GGGCTCTGCCCCAGGCTCTCCTGCAGGCAGCCCTACCTCCACCGAAGAGGGCAC
CAGCACAGAGCCTTCTGAGGGCAGCGCCCCAGGCACCTCTACAGAGCCAAGCGA
GCTCGAGTCCGGCCAGGGGAACGGCCCTTCCAGTGTCGGATCTGCATGAGAAA
CTTTTCACGAGTCGATCACCTCCACCGCCACCTGCGAACCCACACTGGAGAGAA
ACCCTTTCAGTGCAGGATATGTATGCGGAATTTTTCCAGGTCCGACCACCTCAG
CTTGCACTTGAAGACACATACCGGGGAGGCGGTAGTCAGAAGCCTTTCCAATG
CCGGATTTGCATGAGGAACTTCTCCCAATCTAGTTCATTGGTACAGCATCTTAG
GACACATACAGGCGAGAAGCCATTCCAGTGTAGGATCTGCATGCGCAATTTTAG
CCGAAAAGAGCGGCTGGCGACCCACTTGAAAACGCATACAGGTAGTCAGAAGCC
TTTTCAGTGCAGGATCTGCATGAGGAATTTTAGTGTAGCGCATAACTTGACACG
GCACTTGCGCACGCATACTGGAGAGAAGCCCTTTCAGTGTAGGATTTGTATGCG
GAACTTCAGCATTTCCCATAATCTGGCGCGGCACCTGAAGACTCATTTGCGCGG
GTCTAGCCCCAAGAAGAAGAGAAAGGTGGGAGTCGACGGATCCAGCGGCTCCGA
GACCCCAGGCACATCTGAGAGCGCCACCCCTGAGTCCGGACCCTGGTGACATT
CAAGGACGTGTTCGTGGACTTCACCCGGGAGGAGTGGAAGCTGCTGGACACAGC
CCAGCAGATCGTGTACAGGAACGTGATGCTGGAGAACTATAAGAATCTGGTGTC
TCTGGGCTACCAGCTGACAAAGCCAGATGTGATCCTGCGGCTGGAGAAGGGAGA
GGGAGCCCTGGCTGGTGTAGTCTAGAAATCAACCTCTGGATTACAAAATTTGTGA
AAGATTGACTGGTATTCTTAACTATGTTGCTCCTTTTACGCTATGTGGATACGC
TGCTTTAATGCCTTTGTATCATGCTATTGCTTCCCGTATGGCTTTCATTTTCTC |

TABLE 18-continued

Sequence listing.

| SEQ | Description | Sequence |
|---|---|---|
| | | CTCCTTGTATAAATCCTGGTTGCTGTCTCTTTATGAGGAGTTGTGGCCCGTTGT<br>CAGGCAACGTGGCGTGGTGTGCACTGTGTTTGCTGACGCAACCCCCACTGGTTG<br>GGGCATTGCCACCACCTGTCAGCTCCTTTCCGGGACTTTCGCTTTCCCCCTCCC<br>TATTGCCACGGCGGAACTCATCGCCGCCTGCCTTGCCCGCTGCTGGACAGGGGC<br>TCGGCTGTTGGGCACTGACAATTCCGTGGTGTTGTCGGGGAAATCATCGTCCTT<br>TCCTTGGCTGCTCGCCTGTGTTGCCACCTGGATTCTGCGCGGGACGTCCTTCTG<br>CTACGTCCCTTCGGCCCTCAATCCAGCGGACCTTCCTTCCCGCGGCCTGCTGCC<br>GGCTCTGCGGCCTCTTCCGCGTCTTCGCCTTCGCCCTCAGACGAGTCGGATCTC<br>CCTTTGGGCCGCCTCCCCGCCTGTTAATTAAAAAAAAAAAAAAAAAAAAAAAAA<br>AAAAAAAAAAAAAAAAAAAAAAAAAAACTAGTGGCGCCTGATGCGGTATTTTCT<br>CCTTACGCATCTGTGCGGTATTTCACACCGCATAATCCAGCACAGTGGCGGCCC<br>GTTTAAACCCGCTGATCAGCCTCGACTGTGCCTTCTAGTTGCCAGCCATCTGTT<br>GTTTGCCCCTCCCCCGTGCCTTCCTTGACCCTGGAAGGTGCCACTCCCACTGTC<br>CTTTCCTAATAAAATGAGGAAATTGCATCGCATTGTCTGAGTAGGTGTCATTCT<br>ATTCTGGGGGGTGGGGTGGGGCAGGACAGCAAGGGGGAGGATTGGGAAGACAAT<br>AGCAGGCATGCTGGGGATGCGGTGGGCTCTATGGCTTCTGAGGCGGAAAGAACC<br>AGCTGCATTAATGAATCGGCCAACGCGCGGGGAGAGGCGGTTTGCGTATTGGGC<br>GCTCTTCCGCTTCCTCGCTCACTGACTCGCTGCGCTCGGTCGTTCGGCTGCGGC<br>GAGCGGTATCAGCTCACTCAAAGGCGGTAATACGGTTATCCACAGAATCAGGGG<br>ATAACGCAGGAAAGAACATGTGAGCAAAAGGCCAGCAAAAGGCCAGGAACCGTA<br>AAAAGGCCGCGTTGCTGGCGTTTTTCCATAGGCTCCGCCCCCCTGACGAGCATC<br>ACAAAAATCGACGCTCAAGTCAGAGGTGGCGAAACCCGACAGGACTATAAAGAT<br>ACCAGGCGTTTCCCCCTGGAAGCTCCCTCGTGCGCTCTCCTGTTCCGACCCTGC<br>CGCTTACCGGATACCTGTCCGCCTTTCTCCCTTCGGGAAGCGTGGCGCTTTCTC<br>ATAGCTCACGCTGTAGGTATCTCAGTTCGGTGTAGGTCGTTCGCTCCAAGCTGG<br>GCTGTGTGCACGAACCCCCCGTTCAGCCCGACCGCTGCGCCTTATCCGGTAACT<br>ATCGTCTTGAGTCCAACCCGGTAAGACACGACTTATCGCCACTGGCAGCAGCCA<br>CTGGTAACAGGATTAGCAGAGCGAGGTATGTAGGCGGTGCTACAGAGTTCTTGA<br>AGTGGTGGCCTAACTACGGCTACACTAGAAGAACAGTATTTGGTATCTGCGCTC<br>TGCTGAAGCCAGTTACCTTCGGAAAAAGAGTTGGTAGCTCTTGATCCGGCAAAC<br>AAACCACCGCTGGTAGCGGTTTTTTTGTTTGCAAGCAGCAGATTACGCGCAGAA<br>AAAAAGGATCTCAAGAAGATCCTTTGATCTTTTCTACGGGGTCTGACGCTCAGT<br>GGAACGAAAACTCACGTTAAGGGATTTTGGTCATGAGATTATCAAAAAGGATCT<br>TCACCTAGATCCTTTTAAATTAAAAATGAAGTTTTAAATCAATCTAAAGTATAT<br>ATGAGTAAACTTGGTCTGACAGTTACCAATGCTTAATCAGTGAGGCACCTATCT<br>CAGCGATCTGTCTATTTCGTTCATCCATAGTTGCCTGACTCCCCGTCGTGTAGA<br>TAACTACGATACGGGAGGGCTTACCATCTGGCCCCAGTGCTGCAATGATACCGC<br>GAGACCCACGCTCACCGGCTCCAGATTTATCAGCAATAAACCAGCCAGCCGGAA<br>GGGCCGAGCGCAGAAGTGGTCCTGCAACTTTATCCGCCTCCATCCAGTCTATTA<br>ATTGTTGCCGGGAAGCTAGAGTAAGTAGTTCGCCAGTTAATAGTTTGCGCAACG<br>TTGTTGCCATTGCTACAGGCATCGTGGTGTCACGCTCGTCGTTTGGTATGGCTT<br>CATTCAGCTCCGGTTCCCAACGATCAAGGCGAGTTACATGATCCCCCATGTTGT<br>GCAAAAAAGCGGTTAGCTCCTTCGGTCCTCCGATCGTTGTCAGAAGTAAGTTGG<br>CCGCAGTGTTATCACTCATGGTTATGGCAGCACTGCATAATTCTCTTACTGTCA<br>TGCCATCCGTAAGATGCTTTTCTGTGACTGGTGAGTACTCAACCAAGTCATTCT<br>GAGAATAGTGTATGCGGCGACCGAGTTGCTCTTGCCCGGCGTCAATACGGGATA<br>ATACCGCGCCACATAGCAGAACTTTAAAAGTGCTCATCATTGGAAAACGTTCTT<br>CGGGGCGAAAACTCTCAAGGATCTTACCGCTGTTGAGATCCAGTTCGATGTAAC<br>CCACTCGTGCACCCAACTGATCTTCAGCATCTTTTACTTTCACCAGCGTTTCTG<br>GGTGAGCAAAAACAGGAAGGCAAAATGCCGCAAAAAAGGGAATAAGGGCGACAC<br>GGAAATGTTGAATACTCATACTCTTCCTTTTTCAATATTATTGAAGCATTTATC<br>AGGGTTATTGTCTCATGAGCGGATACATATTTGAATGTATTTAGAAAAATAAAC<br>AAATAGGGGTTCCGCGCACATTTCCCCGAAAAGTGCCACCTGA |
| 1246 | Plasmid for expression of CRISPR-Off fusion protein (nt) | GGGCGCTCGAGCAGGTTCAGAAGGAGATCAAAAACCCCCAAGGATCAAACATGC<br>CAAAAAGAAGAGAAAGGTACCGAAGAAAAAAGAAAGGTATACAATCACGATC<br>AGGAGTTCGACCCCCCTAAGGTGTACCCACCAGTGCCTGCAGAGAAGAGGAAGC<br>CAATCCGGGTGCTGAGCCTGTTTGATGGCATCGCCACCGGCTGCTGGTGCTGA<br>AGGATCTGGGCATCCAGGTGGACCGGTACATCGCCTCCGAGGTGTGCGAGGATT<br>CTATCACCGTGGGCATGGTGCGCCACCAGGGCAAGATCATGTATGTGGGCGACG<br>TGCGGTCCGTGACACAGAAGCACATCCAGGAGTGGGGCCCATTCGATCTGGTGA<br>TCGGCGGCAGCCCCTGTAATGACCTGTCCATCGTGAACCCTGCAAGGAAGGGAC<br>TGTACGAGGGAACCGGCCGGCTGTTCTTTGAGTTTTATAGACTGCTGCACGACG<br>CCAGGCCTAAGGAGGGCGACGATAGACCATTCTTTTGGCTGTTCGAGAATGTGG<br>TGGCTATGGGCGTGAGCGATAAGAGGGACATCTCCAGGTTTCTGGAGTCTAACC<br>CCGTGATGATCGATGCAAAGGAGGTGTCCGCCGCACACAGAGCCAGGTATTTCT<br>GGGGCAATCTGCCAGGAATGAACAGGCCACTGGCAAGCACCGTGAATGACAAGC<br>TGGAGCTGCAGGAGTGCCTGGAGCACGGAAGGATCGCCAAGTTTTCCAAGGTGC<br>GCACAATCACCACACGGAGCAATTCCATCAAGCAGGGCAAGGATCAGCACTTCC<br>CCGTGTTCATGAACGAGAAGGAGGACATCCTGTGGTGTACCGAGATGGAGAGAG<br>TGTTCGGCTTTCCAGTGCACTACACAGACGTGTCTAACATGAGCAGGCTGGCAA<br>GGCAGCGGCTGCTGGGCAGATCTTGGAGCGTGCCCGTGATCAGGCACCTGTTCG<br>CCCCTCTGAAGGAGTATTTTGCCTGCGTGAGCAGCGGCAACTCCAATGCCAACA<br>GCCGGGGCCCCTCTTTCAGCTCCGGATTGGTGCCTCTGAGCCTGAGGGGCTCCC<br>ACATGGCAGCAATCCCCGCCCTGGACCCCGAGGCCGAGCCTAGCATGGACGTGA<br>TCCTGGTGGGCTCTAGCGAGCTGTCCTCTAGCGTGTCTCCAGGAACCGGAAGGG |

TABLE 18-continued

Sequence listing.

| SEQ | Description | Sequence |
|---|---|---|
| | | ATCTGATCGCATACGAGGTGAAGGCCAATCAGCGGAACATCGAGGACATCTGTA
TCTGCTGTGGCAGCCTGCAGGTGCACACACAGCACCCACTGTTCGAGGGAGGAA
TCTGCGCACCCTGTAAGGATAAGTTCCTGGACGCCCTGTTTCTGTACGACGATG
ACGGCTACCAGTCCTATTGCTCTATCTGCTGTTCCGGCGAGACCCTGCTGATCT
GCGGCAATCCAGATTGTACAAGGTGCTATTGTTTTGAGTGCGTGGACTCTCTGG
TGGGACCAGGCACCAGCGGAAAGGTGCACGCCATGTCCAACTGGGTGTGCTACC
TGTGCCTGCCATCCTCTCGCAGCGGACTGCTGCAGCGGAGAAGGAAGTGGAGAT
CCCAGCTGAAGGCCTTCTATGATAGGGAGTCTGAGAACCCCCTGGAGATGTTTG
AGACCGTGCCAGTGTGGCGCCGGCAGCCCGTGAGGGTGCTGAGCCTGTTCGAGG
ATATCAAGAAGGAGCTGACATCCCTGGGCTTTCTGGAGTCCGGCTCTGACCCCG
GACAGCTGAAGCACGTGGTGGATGTGACCGACACAGTGCGGAAGGATGTGGAGG
AGTGGGGCCCTTTCGACCTGGTGTACGGAGCAACCCCTCCACTGGGACACACAT
GCGACAGACCCCCTTCTTGGTACCTGTTCCAGTTTCACCGCCTGCTGCAGTATG
CAAGGCCAAAGCCAGGCAGCCCTAGACCATTCTTTTGGATGTTCGTGGATAATC
TGGTGCTGAACAAGGAGGATCTGGACGTGGCCAGCAGGTTTCTGGAGATGGAGC
CAGTGACCATCCCAGACGTGCACGGCGGCTCCCTGCAGAATGCCGTGCGCGTGT
GGTCTAACATCCCTGCCATCAGAAGCAGGCACTGGGCACTGGTGAGCGAGGAGG
AGCTGTCCCTGCTGGCCCAGAATAAGCAGAGCAGCAAGCTGGCCGCCAAGTGGC
CTACAAAGCTGGTGAAGAACTGCTTCCTGCCACTGCGGGAGTACTTCAAGTATT
TTTCCACCGAGCTGACATCTAGCCTGGGAGGACCCTCCTCTGGCGCCCCACCAC
CTAGCGGCGGCTCCCCTGCCGGCTCTCCAACCAGCACAGAGGAGGGCACCAGCG
AGTCCGCCACACCAGAGTCTGGACCTGGCACCAGCACAGAGCCATCCGAGGGCT
CTGCCCCAGGCTCTCCTGCAGGCAGCCCTACCTCCACCGAAGAGGGCACCAGCA
CAGAGCCTTCTGAGGGCAGCGCCCCAGGCACCTCTACAGAGCCAAGCGAGCTCG
AGGACAAGAAGTACAGCATCGGCCTGGCCATCGGCACCAACTCTGTGGGCTGGG
CCGTGATCACCGACGAGTACAAGGTGCCCAGCAAGAAATTCAAGGTGCTGGGCA
ACACCGACCGGCACAGCATCAAGAAGAACCTGATCGGAGCCCTGCTGTTCGACA
GCGGCGAAACAGCCGAGGCCACCCGGCTGAAGAGAACCGCCAGAAGAAGATACA
CCAGACGGAAGAACCGGATCTGCTATCTGCAAGAGATCTTCAGCAACGAGATGG
CCAAGGTGGACGACAGCTTCTTCCACAGACTGGAAGAGTCCTTCCTGGTGGAAG
AGGATAAGAAGCACGAGCGGCACCCCATCTTCGGCAACATCGTGGACGAGGTGG
CCTACCACGAGAAGTACCCCACCATCTACCACCTGAGAAAGAAACTGGTGGACA
GCACCGACAAGGCCGACCTGCGGCTGATCTATCTGGCCCTGGCCCACATGATCA
AGTTCCGGGGCCACTTCCTGATCGAGGGCGACCTGAACCCCGACAACAGCGACG
TGGACAAGCTGTTCATCCAGCTGGTGCAGACCTACAACCAGCTGTTCGAGGAAA
ACCCCATCAACGCCAGCGGCGTGGACGCCAAGGCCATCCTGTCTGCCAGACTGA
GCAAGAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAACTTCA
AGAGCAACTTCGACCTGGCCGAGGATGCCAAACTGCAGCTGAGCAAGGACACCT
ACGACGACGACCTGGACAACCTGCTGGCCCAGATCGGCGACCAGTACGCCGACC
TGTTTCTGGCCGCCAAGAACCTGTCCGACGCCATCCTGCTGAGCGACATCCTGA
GAGTGAACACCGAGATCACCAAGGCCCCCCTGAGCGCCTCTATGATCAAGAGAT
ACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCG
GCTACATTGACGGCGGAGCCAGCCAGGAAGAGTTCTACAAGTTCATCAAGCCCA
TCCTGGAAAAGATGGACGGCACCGAGGAACTGCTCGTGAAGCTGAACAGAGAGG
ACCTGCTGCGGAAGCAGCGGACCTTCGACAACGGCAGCATCCCCCACCAGATCC
ACCTGGGAGAGCTGCACGCCATTCTGCGGCGGCAGGAAGATTTTTACCCATTCC
TGAAGGACAACCGGGAAAAGATCGAGAAGATCCTGACCTTCCGCATCCCCTACT
ACGTGGGCCCTCTGGCCAGGGGAAACAGCAGATTCGCCTGGATGACCAGAAAGA
GCGAGGAAACCATCACCCCCTGGAACTTCGAGGAAGTGGTGGACAAGGGCGCTT
CCGCCCAGAGCTTCATCGAGCGGATGACCAACTTCGATAAGAACCTGCCCAACG
AGAAGGTGCTGCCCAAGCACAGCCTGCTGTACGAGTACTTCACCGTGTATAACG
AGCTGACCAAAGTGAAATACGTGACCGAGGGAATGAGAAAGCCCGCCTTCCTGA
GCGGCGAGCAGAAAAAGGCCATCGTGGACCTGCTGTTCAAGACCAACCGGAAAG
TGACCGTGAAGCAGCTGAAAGAGGACTACTTCAAGAAAATCGAGTGCTTCGACT
CCGTGGAAATCTCCGGCGTGGAAGATCGGTTCAACGCCTCCCTGGGCACATACC
ACGATCTGCTGAAAATTATCAAGGACAAGGACTTCCTGGACAATGAGGAAAACG
AGGACATTCTGGAAGATATCGTGCTGACCCTGACACTGTTTGAGGACAGAGAGA
TGATCGAGGAACGGCTGAAAACCTATGCCCACCTGTTCGACGACAAAGTGATGA
AGCAGCTGAAGCGGCGGAGATACACCGGCTGGGCAGGCTGAGCCGGAAGCTGA
TCAACGGCATCCGGGACAAGCAGTCCGGCAAGACAATCCTGGATTTCCTGAAGT
CCGACGGCTTCGCCAACAGAAACTTCATGCAGCTGATCCACGACGACAGCCTGA
CCTTTAAAGAGGACATCCAGAAAGCCCAGGTGTCCGGCCAGGGCGATAGCCTGC
ACGAGCACATTGCCAATCTGGCCGGCAGCCCCGCCATTAAGAAGGGCATCCTGC
AGACAGTGAAGGTGGTGGACGAGCTCGTGAAAGTGATGGGCCGGCACAAGCCCG
AGAACATCGTGATCGAAATGGCCAGAGAGAACCAGACCACCCAGAAGGGACAGA
AGAACAGCCGCGAGAGAATGAAGCGGATCGAAGAGGGCATCAAAGAGCTGGGCA
GCCAGATCCTGAAAGAACACCCCGTGGAAAACACCCAGCTGCAGAACGAGAAGC
TGTACCTGTACTACCTGCAGAATGGGGGGATATGTACGTGGACCAGGAACTGGG
ACATCAACCGGCTGTCCGACTACGATGTGGACGCCATCGTGCCTCAGAGCTTTC
TGAAGGACGACTCCATCGACAACAAGGTGCTGACCAGAAGCGACAAGAACCGGG
GCAAGAGCGACAACGTGCCCTCCGAAGAGGTCGTGAAGAAGATGAAGAACTACT
GGCGGCAGCTGCTGAACGCCAAGCTGATTACCCAGAGAAAGTTCGACAATCTGA
CCAAGGCCGAGAGAGGCGGCCTGAGCGAACTGGATAAGGCCGGCTTCATCAAGA
GACAGCTGGTGGAAACCCGGCAGATCACAAAGCACGTGGCACAGATCCTGGACT |

TABLE 18-continued

Sequence listing.

| SEQ | Description | Sequence |
|---|---|---|
| | | CCCGGATGAACACTAAGTACGACGAGAATGACAAGCTGATCCGGGAAGTGAAAG
TGATCACCCTGAAGTCCAAGCTGGTGTCCGATTTCCGGAAGGATTTCCAGTTTT
ACAAAGTGCGCGAGATCAACAACTACCACCACGCCCACGACGCCTACCTGAACG
CCGTCGTGGGAACCGCCCTGATCAAAAAGTACCCTAAGCTGGAAAGCGAGTTCG
TGTACGGCGACTACAAGGTGTACGACGTGCGGAAGATGATCGCCAAGAGCGAGC
AGGAAATCGGCAAGGCTACCGCCAAGTACTTCTTCTACAGCAACATCATGAACT
TTTTCAAGACCGAGATTACCCTGGCCAACGGCGAGATCCGGAAGCGGCCTCTGA
TCGAGACAAACGGCGAAACCGGGGAGATCGTGTGGGATAAGGGCCGGGATTTTG
CCACCGTGCGGAAAGTGCTGAGCATGCCCCAAGTGAATATCGTGAAAAAGACCG
AGGTGCAGACAGGCGGCTTCAGCAAAGAGTCTATCCTGCCCAAGAGGAACAGCG
ATAAGCTGATCGCCAGAAAGAAGGACTGGGACCCTAAGAAGTACGGCGGCTTCG
ACAGCCCCACCGTGGCCTATTCTGTGCTGGTGGTGGCCAAAGTGGAAAAGGGCA
AGTCCAAGAAACTGAAGAGTGTGAAAGAGCTGCTGGGGATCACCATCATGGAAA
GAAGCAGCTTCGAGAAGAATCCCATCGACTTTCTGGAAGCCAAGGGCTACAAAG
AAGTGAAAAAGGACCTGATCATCAAGCTGCCTAAGTACTCCCTGTTCGAGCTGG
AAAACGGCCGGAAGAGAATGCTGGCCTCTGCCGGCGAACTGCAGAAGGGAAACG
AACTGGCCCTGCCCTCCAAATATGTGAACTTCCTGTACCTGGCCAGCCACTATG
AGAAGCTGAAGGGCTCCCCCGAGGATAATGAGCAGAAACAGCTGTTTGTGGAAC
AGCACAAGCACTACCTGGACGAGATCATCGAGCAGATCAGCGAGTTCTCCAAGA
GAGTGATCCTGGCCGACGCTAATCTGGACAAAGTGCTGTCCGCCTACAACAAGC
ACCGGGATAAGCCCATCAGAGAGCAGGCCGAGAATATCATCCACCTGTTTACCC
TGACCAATCTGGGAGCCCCTGCCGCCTTCAAGTACTTTGACACCACCATCGACC
GGAAGAGGTACACCAGCACCAAAGAGGTGCTGGACGCCACCCTGATCCACCAGA
GCATCACCGGCCTGTACGAGACACGGATCGACCTGTCTCAGCTGGGAGGCGACA
GCCCCAAGAAGAAGAGAAAGGTGGGAGTCGACGATCCAGCGGCTCCGAGACCC
CAGGCACATCTGAGAGCGCCACCCCTGAGTCCACCGGTATGAACAATTCACAGG
GGAGAGTGACATTCGAAGACGTGACCGTGAACTTCACCCAGGGAGAATGGCAGC
GCTTGAACCCAGAACAAAGGAACCTCTATCGGGACGTGATGCTGGAAAACTACT
CAAATTTGGTGAGCGTTGGGCAGGGTGAGACCACTAAGCCTGACGTGATCCTGA
GATTGGAACAGGGCAAGGAGCCTTGGCTCGAGGAAGAGGAAGTCCTGGGCTCAG
GGAGGGCCGAGAAAAACGGTGATATAGGAGGCCAGATATGGAAGCCTAAGGACG
TCAAGGAGAGCCTGAGCGCTCCCAAGAAGAAAGGAAGGTCCCAAAGAAAAAAA
GAAAGGTGTGAGGATCCTGAGTCTAGAAATCAACCTCTGGATTACAAAATTTGT
GAAAGATTGACTGGTATTCTTAACTATGTTGCTCCTTTTACGCTATGTGGATAC
GCTGCTTTAATGCCTTTGTATCATGCTATTGCTTCCCGTATGGCTTTCATTTTC
TCCTCCTTGTATAAATCCTGGTTGCTGTCTCTTTATGAGGAGTTGTGGCCCGTT
GTCAGGCAACGTGGCGTGGTGTGCACTGTGTTTGCTGACGCAACCCCCACTGGT
TGGGGCATTGCCACCACCTGTCAGCTCCTTTCCGGGACTTTCGCTTTCCCCCTC
CCTATTGCCACGCGGAACTCATCGCCGCCTGCCTTGCCCGCTGCTGGACAGGG
GCTCGGCTGTTGGGCACTGACAATTCCGTGGTGTTGTCGGGGAAATCATCGTCC
TTTCCTTGGCTGCTCGCCTGTGTTGCCACCTGGATTCTGCGCGGGACGTCCTTC
TGCTACGTCCCTTCGGCCCTCAATCCAGCGGACCTTCCTTCCCGCGGCCTGCTG
CCGGCTCTGCGGCCTCTTCCGCGTCTTCGCCTTCGCCCTCAGACGAGTCGGATC
TCCCTTTGGGCCGCCTCCCCGCCTGTTAATTAAAAAAAAAAAAAAAAAAAAAAAA
AAAAAAAAAAAAAAAAAAAAAAAAAAAAAAAAAAAAAAAAAAAAAAAAAAAAAA
AAAAAAAAAAAAAAAAAAAGCTTGAAGAGCCTAGTGGCGCCTGATGCGG
TATTTTCTCCTTACGCATCTGTGCGGTATTTCACACCGCATAATCCAGCACAGT
GGCGGCCCGTTTAAACCCGCTGATCAGCCTCGACTGTGCCTTCTAGTTGCCAGC
CATCTGTTGTTTGCCCCTCCCCCGTGCCTTCCTTGACCCTGGAAGGTGCCACTC
CCACTGTCCTTTCCTAATAAAATGAGGAAATTGCATCGCATTGTCTGAGTAGGT
GTCATTCTATTCTGGGGGGTGGGGTGGGCAGGACAGCAAGGGGGAGGATTGGG
AAGACAATAGCAGGCATGCTGGGGATGCGGTGGGCTCTATGGCTTCTGAGGCGG
AAAGAACCAGCTGCATTAATGAATCGGCCAACGCGCGGGGAGAGGCGGTTTGCG
TATTGGGCGCTCTTCCGCTTCCTCGCTCACTGACTCGCTGCGCTCGGTCGTTCG
GCTGCGGCGAGCGGTATCAGCTCACTCAAAGGCGGTAATACGGTTATCCACAGA
ATCAGGGGATAACGCAGGAAAGAACATGTGAGCAAAAGGCCAGCAAAAGGCCAG
GAACCGTAAAAAGGCCGCGTTGCTGGCGTTTTTCCATAGGCTCCGCCCCCCTGA
CGAGCATCACAAAAATCGACGCTCAAGTCAGAGGTGGCGAAACCCGACAGGACT
ATAAAGATACCAGGCGTTTCCCCCTGGAAGCTCCCTCGTGCGCTCTCCTGTTCC
GACCCTGCCGCTTACCGGATACCGTCCGCCTTTCTCCCTTCGGGAAGCGTGGC
GCTTTCTCATAGCTCACGCTGTAGGTATCTCAGTTCGGTGTAGGTCGTTCGCTC
CAAGCTGGGCTGTGTGCACGAACCCCCCGTTCAGCCCGACCGCTGCGCCTTATC
CGGTAACTATCGTCTTGAGTCCAACCCGGTAAGACACGACTTATCGCCACTGGC
AGCAGCCACTGGTAACAGGATTAGCAGAGCGAGGTATGTAGGCGGTGCTACAGA
GTTCTTGAAGTGGTGGCCTAACTACGGCTACACTAGAAGAACAGTATTTGGTAT
CTGCGCTCTGCTGAAGCCAGTTACCTTCGGAAAAAGAGTTGGTAGCTCTTGATC
CGGCAAACAAACCACCGCTGGTAGCGGTGGTTTTTTTGTTTGCAAGCAGCAGAT
TACGCGCAGAAAAAAAGGATCTCAAGAAGATCCTTTGATCTTTTCTACGGGGTC
TGACGCTCAGTGGAACGAAAACTCACGTTAAGGGATTTTGGTCATGAGATTATC
AAAAAGGATCTTCACCTAGATCCTTTTAAATTAAAAATGAAGTTTTAAATCAAT
CTAAAGTATATATGAGTAAACTTGGTCTGACAGTTAGAAAAACTCATCGAGCAT
CAAATGAAACTGCAATTTATTCATATCAGGATTATCAATACCATATTTTTGAAA
AAGCCGTTTCTGTAATGAAGGAGAAAACTCACCGAGGCAGTTCCATAGGATGGC
AAGATCCTGGTATCGGTCTGCGATTCCGACTCGTCCAACATCAATACAACCTAT
TAATTTCCCCTCGTCAAAAATAAGGTTATCAAGTGAGAAATCACCATGAGTGAC
GACTGAATCCGGTGAGAATGGCAAAAGTTTATGCATTTCTTTCCAGACTTGTTC |

TABLE 18-continued

Sequence listing.

| SEQ | Description | Sequence |
|---|---|---|
|  |  | AACAGGCCAGCCATTACGCTCGTCATCAAAATCACTCGCATCAACCAAACCGTT<br>ATTCATTCGTGATTGCGCCTGAGCGAAACGAAATACGCGATCGCTGTTAAAAGG<br>ACAATTACAAACAGGAATCGAATGCAACCGGCGCAGGAACACTGCCAGCGCATC<br>AACAATATTTTCACCTGAATCAGGATATTCTTCTAATACCTGGAATGCTGTTTT<br>CCCAGGGATCGCAGTGGTGAGTAACCATGCATCATCAGGAGTACGGATAAAATG<br>CTTGATGGTCGGAAGAGGCATAAATTCCGTCAGCCAGTTTAGTCTGACCATCTC<br>ATCTGTAACATCATTGGCAACGCTACCTTTGCCATGTTTCAGAAACAACTCTGG<br>CGCATCGGGCTTCCCATACAATCGATAGATTGTCGCACCTGATTGCCCGACATT<br>ATCGCGAGCCCATTTATACCCATATAAATCAGCATCCATGTTGGAATTTAATCG<br>CGGCCTAGAGCAAGACGTTTCCCGTTGAATATGGCTCATACTCTTCCTTTTTCA<br>ATATTATTGAAGCATTTATCAGGGTTATTGTCTCATGAGCGGATACATATTTGA<br>ATGTATTTAGAAAAATAAACAAATAGGGGTTCCGCGCACATTTCCCCGAAAAGT<br>GCCACCTGACGTCGATCGACGGATCGGGAGATCTCCCGATCCCCTATGGTGCAC<br>TCTCAGTACAATCTGCTCTGATGCCGCATAGTTAAGCCAGTATCTGCTCCCTGC<br>TTGTGTGTTGGAGGTCGCTGAGTAGTGCGCGAGCAAAATTTAAGCTACAACAAG<br>GCAAGGCTTGACCGACAATTGCATGAAGAATCTGCTTAGGGTTAGGCGTTTTGC<br>GCTGCTTCGCGATGTACGGGCCAGATATACGCGTTGACATTGATTATTGACTAG<br>TTATTAATAGTAATCAATTACGGGGTCATTAGTTCATAGCCCATATATGGAGTT<br>CCGCGTTACATAACTTACGGTAAATGGCCCGCCTGGCTGACCGCCCAACGACCC<br>CCGCCCATTGACGTCAATAATGACGTATGTTCCCATAGTAACGCCAATAGGGAC<br>TTTCCATTGACGTCAATGGGTGGAGTATTTACGGTAAACTGCCCACTTGGCAGT<br>ACATCAAGTGTATCATATGCCAAGTACGCCCCCTATTGACGTCAATGACGGTAA<br>ATGGCCCGCCTGGCATTATGCCCAGTACATGACCTTATGGGACTTTCCTACTTG<br>GCAGTACATCTACGTATTAGTCATCGCTATTACCATGGTGATGCGGTTTTGGCA<br>GTACATCAATGGGCGTGGATAGCGGTTTGACTCACGGGGATTTCCAAGTCTCCA<br>CCCCATTGACGTCAATGGGAGTTTGTTTTGGCACCAAAATCAACGGGACTTTCC<br>AAAATGTCGTAACAACTCCGCCCCATTGACGCAAATGGGGGGTAGGCGTGTACG<br>GTGGGAGGTCTATATAAGCAGAGCTCTCTGGCTAACTAGAGAACCCACTGCTTA<br>CTGGCTTATCGAAATTAATACGACTCACTATAAG |
| 1247 | Coding region of plasmid for expression of CRISPR-Off fusion protein (nt) | ATGCCAAAAAAGAAGAGAAAGGTACCGAAGAAAAAAAGAAAGGTATACAATCAC<br>GATCAGGAGTTCGACCCCCCTAAGGTGTACCCACCAGTGCCTGCAGAGAAGAGG<br>AAGCCAATCCGGGTGCTGAGCCTGTTTGATGGCATCGCCACCGGCTGCTGGTG<br>CTGAAGGATCTGGGCATCCAGGTGGACCGGTACATCGCCTCCGAGGTGTGCGAG<br>GATTCTATCACCGTGGGCATGGTGCGCCACCAGGGCAAGATCATGTATGT<br>GACGTGCGGTCCGTGACACAGAAGCACATCCAGGAGTGGGGCCCATTCGATCTG<br>GTGATCGGCGGCAGCCCCTGTAATGACCTGTCCATCGTGAACCCTGCAAGGAAG<br>GGACTGTACGAGGGAACCGGCCGGCTGTTCTTTGAGTTTTATAGACTGCTGCAC<br>GACGCCAGGCCTAAGGAGGGCGACGATAGACCATTCTTTTGGCTGTTCGAGAAT<br>GTGGTGGCTATGGGCGTGAGCGATAAGAGGGACATCTCCAGGTTTCTGGAGTCT<br>AACCCCGTGATGATCGATGCAAAGGAGGTGTCCGCCGCACACAGAGCCAGGTAT<br>TTCTGGGGCAATCTGCCAGGAATGAACAGGCCACTGGCAAGCACCGTGAATGAC<br>AAGCTGGAGCTGCAGGAGTGCCTGGAGCACGGAAGGATCGCCAAGTTTTCCAAG<br>GTGCGCACAATCACCACACGGAGCAATTCCATCAAGCAGGGCAAGGATCAGCAC<br>TTCCCCGTGTTCATGAACGAGAAGGAGGACATCCTGTGGTGTACCGAGATGGAG<br>AGAGTGTTCGGCTTTCCAGTGCACTACACAGACGTGTCTAACATGAGCAGGCTG<br>GCAAGGCAGCGGCTGCTGGGCAGATCTTGGAGCGTGCCCGTGATCAGGCACCTG<br>TTCGCCCCTCTGAAGGAGTATTTTGCCTGCGTGAGCAGCGGCAACTCCAATGCC<br>ACAGCCGGGGCCCCTCTTTCAGCTCCGGATTGGTGCCTCTGAGCCTGAGGGGC<br>TCCCACATGGCAGCAATCCCCGCCCTGGACCCCGAGGCCGAGCCTAGCATGGAC<br>GTGATCCTGGTGGGCTCTAGCGAGCTGTCCTCTAGCGTGTCTCCAGGAACCGGA<br>AGGGATCTGATCGCATACGAGGTGAAGGCCAATCAGCGGAACATCGAGGACATC<br>TGTATCTGCTGTGGCAGCCTGCAGGTGCACACACAGCACCCACTGTTCGAGGGA<br>GGAATCTGCGCACCCTGTAAGGATAAGTTCCTGGACGCCCTGTTTCTGTACGAC<br>GATGACGGCTACCAGTCCTATTGCTCTATCTGCTGTTCCGGCGAGACCCTGCTG<br>ATCTGCGGCAATCCAGATTGTACAAGGTGCTATTGTTTTGAGTGCGTGGACTCT<br>CTGGTGGGACCAGGCACCAGCGGAAAGGTGCACGCCATGTCCAACTGGGTGTGC<br>TACCTGTGCCTGCCATCCTCTCGCAGCGGACTGCTGCAGCGGAGAAGGAAGTGG<br>AGATCCCAGCTGAAGGCCTTCTATGATAGGGAGTCTGAGAACCCCCTGGAGATG<br>TTTGAGACCGTGCCAGTGTGGCGCCGGCAGCCCGTGAGGGTGCTGAGCCTGTTC<br>GAGGATATCAAGAAGGAGCTGACATCCCTGGGCTTTCTGGAGTCCGGCTCTGAC<br>CCCGGACAGCTGAAGCACGTGGTGGATGTGACCGACACAGTGCGGAAGGATGTG<br>GAGGAGTGGGGCCCTTTCGACCTGGTGTACGGAGCAACCCCTCCACTGGGACAC<br>ACATGCGACAGACCCCCTTCTTGGTACCTGTTCCAGTTTCACCGCCTGCTGCAG<br>TATGCAAGGCCAAAGCCAGGCAGCCCTAGACCATTCTTTTGGATGTTCGTGGAT<br>AATCTGGTGCTGAACAAGGAGGATCTGGACGTGGCCAGCAGGTTTCTGGAGATG<br>GAGCCAGTGACCATCCCAGACGTGCACGGCGGCTCCCTGCAGAATGCCGTGCGC<br>GTGTGGTCTAACATCCCTGCCATCAGAAGCAGGCACTGGGCACTGGTGAGCGAG<br>GAGGAGCTGTCCCTGCTGGCCCAGAATAAGCAGAGCAGCAAGCTGGCCGCCAAG<br>TGGCCTACAAAGCTGGTGAAGAACTGCTTCCTGCCACTGCGGGAGTACTTCAAG<br>TATTTTTCCACCGAGCTGACATCTAGCCTGGGAGGACCCTCCTCTGGCGCCCCA<br>CCACCTAGCGGCGGCTCCCCTGCCGGCTCTCCAACCAGCACAGAGGAGGGCACC<br>AGCGAGTCCGCCACACCAGAGTCTGGACCTGGCACCAGCACAGAGCCATCCGAG<br>GGCTCTGCCCCAGGCTCTCCTGCAGGCAGCCCTACCTCCACCGAAGAGGGCACC<br>AGCACAGAGCCTTCTGAGGGCAGCGCCCCAGGCACCTCTACAGAGCCAAGCGAG<br>CTCGAGGACAAGAAGTACAGCATCGGCCTGGCCATCGGCACCAACTCTGTGGGC |

TABLE 18-continued

Sequence listing.

| SEQ | Description | Sequence |
|---|---|---|
| | | TGGGCCGTGATCACCGACGAGTACAAGGTGCCCAGCAAGAAATTCAAGGTGCTG |
| | | GGCAACACCGACCGGCACAGCATCAAGAAGAACCTGATCGGAGCCCTGCTGTTC |
| | | GACAGCGGCGAAACAGCCGAGGCCACCCGGCTGAAGAGAACCGCCAGAAGAAGA |
| | | TACACCAGACGGAAGAACCGGATCTGCTATCTGCAAGAGATCTTCAGCAACGAG |
| | | ATGGCCAAGGTGGACGACAGCTTCTTCCACAGACTGGAAGAGTCCTTCCTGGTG |
| | | GAAGAGGATAAGAAGCACGAGCGGCACCCCATCTTCGGCAACATCGTGGACGAG |
| | | GTGGCCTACCACGAGAAGTACCCCACCATCTACCACCTGAGAAAGAAACTGGTG |
| | | GACAGCACCGACAAGGCCGACCTGCGGCTGATCTATCTGGCCCTGGCCCACATG |
| | | ATCAAGTTCCGGGGCCACTTCCTGATCGAGGGCGACCTGAACCCCGACAACAGC |
| | | GACGTGGACAAGCTGTTCATCCAGCTGGTGCAGACCTACAACCAGCTGTTCGAG |
| | | GAAAACCCCATCAACGCCAGCGGCGTGGACGCCAAGGCCATCCTGTCTGCCAGA |
| | | CTGAGCAAGAGCAGACGGCTGGAAAATCTGATCGCCCAGCTGCCCGGCGAGAAG |
| | | AAGAATGGCCTGTTCGGCAACCTGATTGCCCTGAGCCTGGGCCTGACCCCCAAC |
| | | TTCAAGAGCAACTTCGACCTGGCCGAGGATGCCAAACTGCAGCTGAGCAAGGAC |
| | | ACCTACGACGACGACCTGGACAACCTGCTGGCCCAGATCGGCGACCAGTACGCC |
| | | GACCTGTTTCTGGCCGCCAAGAACCTGTCCGACGCCATCCTGCTGAGCGACATC |
| | | CTGAGAGTGAACACCGAGATCACCAAGGCCCCCCTGAGCGCCTCTATGATCAAG |
| | | AGATACGACGAGCACCACCAGGACCTGACCCTGCTGAAAGCTCTCGTGCGGCAG |
| | | CAGCTGCCTGAGAAGTACAAAGAGATTTTCTTCGACCAGAGCAAGAACGGCTAC |
| | | GCCGGCTACATTGACGGCGGAGCCAGCCAGGAAGAGTTCTACAAGTTCATCAAG |
| | | CCCATCCTGGAAAAGATGGACGGCACCGAGGAACTGCTCGTGAAGCTGAACAGA |
| | | GAGGACCTGCTGCGGAAGCAGCGGACCTTCGACAACGGCAGCATCCCCCACCAG |
| | | ATCCACCTGGGAGAGCTGCACGCCATTCTGCGGCGGCAGGAAGATTTTTACCCA |
| | | TTCCTGAAGGACAACCGGGAAAAGATCGAGAAGATCCTGACCTTCCGCATCCCC |
| | | TACTACGTGGGCCCTCTGGCCAGGGGAAACAGCAGATTCGCCTGGATGACCAGA |
| | | AAGAGCGAGGAAACCATCACCCCCTGGAACTTCGAGGAAGTGGTGGACAAGGGC |
| | | GCTTCCGCCCAGAGCTTCATCGAGCGGATGACCAACTTCGATAAGAACCTGCCC |
| | | AACGAGAAGGTGCTGCCCAAGCACAGCCTGCTGTACGAGTACTTCACCGTGTAT |
| | | AACGAGCTGACCAAAGTGAAATACGTGACCGAGGGAATGAGAAAGCCCGCCTTC |
| | | CTGAGCGGCGAGCAGAAAAAGGCCATCGTGGACCTGCTGTTCAAGACCAACCGG |
| | | AAAGTGACCGTGAAGCAGCTGAAAGAGGACTACTTCAAGAAAATCGAGTGCTTC |
| | | GACTCCGTGGAAATCTCCGGCGTGGAAGATCGGTTCAACGCCTCCCTGGGCACA |
| | | TACCACGATCTGCTGAAAATTATCAAGGACAAGGACTTCCTGGACAATGAGGAA |
| | | AACGAGGACATTCTGGAAGATATCGTGCTGACCCTGACACTGTTTGAGGACAGA |
| | | GAGATGATCGAGGAACGGCTGAAAACCTATGCCCACCTGTTCGACGACAAAGTG |
| | | ATGAAGCAGCTGAAGCGGCGGAGATACACCGGCTGGGGCAGGCTGAGCCGGAAG |
| | | CTGATCAACGGCATCCGGGACAAGCAGTCCGGCAAGACAATCCTGGATTTCCTG |
| | | AAGTCCGACGGCTTCGCCAACAGAAACTTCATGCAGCTGATCCACGACGACAGC |
| | | CTGACCTTTAAAGAGGACATCCAGAAAGCCCAGGTGTCCGGCCAGGGCGATAGC |
| | | CTGCACGAGCACATTGCCAATCTGGCCGGCAGCCCCGCCATTAAGAAGGGCATC |
| | | CTGCAGACAGTGAAGGTGGTGGACGAGCTCGTGAAAGTGATGGGCCGGCACAAG |
| | | CCCGAGAACATCGTGATCGAAATGGCCAGAGAGAACCAGACCACCCAGAAGGGA |
| | | CAGAAGAACAGCCGCGAGAGAATGAAGCGGATCGAAGAGGGCATCAAAGAGCTG |
| | | GGCAGCCAGATCCTGAAAGAACACCCCGTGGAAAACACCCAGCTGCAGAACGAG |
| | | AAGCTGTACCTGTACTACCTGCAGAATGGGCGGGATATGTACGTGGACCAGGAA |
| | | CTGGACATCAACCGGCTGTCCGACTACGATGTGGACGCCATCGTGCCTCAGAGC |
| | | TTTCTGAAGGACGACTCCATCGACAACAAGGTGCTGACCAGAAGCGACAAGAAC |
| | | CGGGGCAAGAGCGACAACGTGCCCTCCGAAGAGGTCGTGAAGAAGATGAAGAAC |
| | | TACTGGCGGCAGCTGCTGAACGCCAAGCTGATTACCCAGAGAAAGTTCGACAAT |
| | | CTGACCAAGGCCGAGAGAGGCGGCCTGAGCGAACTGGATAAGGCCGGCTTCATC |
| | | AAGAGACAGCTGGTGGAAACCCGGCAGATCACAAAGCACGTGGCACAGATCCTG |
| | | GACTCCCGGATGAACACTAAGTACGACGAGAATGACAAGCTGATCCGGGAAGTG |
| | | AAAGTGATCACCCTGAAGTCCAAGCTGGTGTCCGATTTCCGGAAGGATTTCCAG |
| | | TTTTACAAAGTGCGCGAGATCAACAACTACCACCACGCCCACGACGCCTACCTG |
| | | AACGCCGTCGTGGGAACCGCCCTGATCAAAAAGTACCCTAAGCTGGAAAGCGAG |
| | | TTCGTGTACGGCGACTACAAGGTGTACGACGTGCGGAAGATGATCGCCAAGAGC |
| | | GAGCAGGAAATCGGCAAGGCTACCGCCAAGTACTTCTTCTACAGCAACATCATG |
| | | AACTTTTTCAAGACCGAGATTACCCTGGCCAACGGCGAGATCCGGAAGCGGCCT |
| | | CTGATCGAGACAAACGGCGAAACCGGGGAGATCGTGTGGGATAAGGGCCGGGAT |
| | | TTTGCCACCGTGCGGAAAGTGCTGAGCATGCCCCAAGTGAATATCGTGAAAAAG |
| | | ACCGAGGTGCAGACAGGCGGCTTCAGCAAAGAGTCTATCCTGCCCAAGAGGAAC |
| | | AGCGATAAGCTGATCGCCAGAAAGAAGGACTGGGACCCTAAGAAGTACGGCGGC |
| | | TTCGACAGCCCCACCGTGGCCTATTCTGTGCTGGTGGTGGCCAAAGTGGAAAAG |
| | | GGCAAGTCCAAGAAACTGAAGAGTGTGAAAGAGCTGCTGGGGATCACCATCATG |
| | | GAAAGAAGCAGCTTCGAGAAGAATCCCATCGACTTTCTGGAAGCCAAGGGCTAC |
| | | AAAGAAGTGAAAAAGGACCTGATCATCAAGCTGCCTAAGTACTCCCTGTTCGAG |
| | | CTGGAAAACGGCCGGAAGAGAATGCTGGCCTCTGCCGGCGAACTGCAGAAGGGA |
| | | AACGAACTGGCCCTGCCCTCCAAATATGTGAACTTCCTGTACCTGGCCAGCCAC |
| | | TATGAGAAGCTGAAGGGCTCCCCCGAGGATAATGAGCAGAAACAGCTGTTTGTG |
| | | GAACAGCACAAGCACTACCTGGACGAGATCATCGAGCAGATCAGCGAGTTCTCC |
| | | AAGAGAGTGATCCTGGCCGACGCTAATCTGGACAAAGTGCTGTCCGCCTACAAC |
| | | AAGCACCGGGATAAGCCCATCAGAGAGCAGGCCGAGAATATCATCCACCTGTTT |
| | | ACCCTGACCAATCTGGGAGCCCCTGCCGCCTTCAAGTACTTTGACACCACCATC |
| | | GACCGGAAGAGGTACACCAGCACCAAAGAGGTGCTGGACGCCACCCTGATCCAC |
| | | CAGAGCATCACCGGCCTGTACGAGACACGGATCGACCTGTCTCAGCTGGGAGGC |
| | | GACAGCCCCAAGAAGAAGAGAAAGGTGGGAGTCGACGGATCCAGCGGCTCCGAG |

TABLE 18-continued

Sequence listing.

| SEQ | Description | Sequence |
|---|---|---|
| | | ACCCCAGGCACATCTGAGAGCGCCACCCCTGAGTCCACCGGTATGAACAATTCA CAGGGGAGAGTGACATTCGAAGACGTGACCGTGAACTTCACCCAGGGAGAATGG CAGCGCTTGAACCCAGAACAAAGGAACCTCTATCGGGACGTGATGCTGGAAAAC TACTCAAATTTGGTGAGCGTTGGGCAGGGTGAGACCACTAAGCCTGACGTGATC CTGAGATTGGAACAGGGCAAGGAGCCTTGGCTCGAGGAAGAGGAAGTCCTGGGC TCAGGGAGGGCCGAGAAAACGGTGATATAGGAGGCCAGATATGGAAGCCTAAG GACGTCAAGGAGAGCCTGAGCGCTCCCAAGAAGAAAAGGAAGGTCCCAAAGAAA AAAAGAAAGGTGTGA |
| 1248 | CRISPR-Off fusion protein (aa) | MPKKKRKVPKKKRKVYNHDQEFDPPKVYPPVPAEKRKPIRVLSLEDGIATGLLV LKDLGIQVDRYIASEVCEDSITVGMVRHQGKIMYVGDVRSVTQKHIQEWGPEDL VIGGSPCNDLSIVNPARKGLYEGTGRLFFEFYRLLHDARPKEGDDRPFFWLFEN VVAMGVSDKRDISRFLESNPVMIDAKEVSAAHRARYFWGNLPGMNRPLASTVND KLELQECLEHGRIAKFSKVRTITTRSNSIKQGKDQHFPVEMNEKEDILWCTEME RVFGFPVHYTDVSNMSRLARQRLLGRSWSVPVIRHLFAPLKEYFACVSSGNSNA NSRGPSFSSGLVPLSLRGSHMAAIPALDPEAEPSMDVILVGSSELSSSVSPGTG RDLIAYEVKANQRNIEDICICCGSLQVHTQHPLFEGGICAPCKDKELDALFLYD DDGYQSYCSICCSGETLLICGNPDCTRCYCFECVDSLVGPGTSGKVHAMSNWVC YLCLPSSRSGLLQRRRKWRSQLKAFYDRESENPLEMFETVPVWRRQPVRVLSLF EDIKKELTSLGFLESGSDPGQLKHVVDVTDTVRKDVEEWGPEDLVYGATPPLGH TCDRPPSWYLFQFHRLLQYARPKPGSPRPFFWMFVDNLVLNKEDLDVASRELEM EPVTIPDVHGGSLQNAVRVWSNIPAIRSRHWALVSEEELSLLAQNKQSSKLAAK WPTKLVKNCFLPLREYFKYFSTELTSSLGGPSSGAPPPSGGSPAGSPTSEEGT SESATPESGPGTSTEPSEGSAPGSPAGSPTSEEGTSTEPSEGSAPGTSTEPSE LEDKKYSIGLAIGTNSVGWAVITDEYKVPSKKFKVLGNTDRHSIKKNLIGALLE DSGETAEATRLKRTARRRYTRRKNRICYLQEIFSNEMAKVDDSFFHRLEESFLV EEDKKHERHPIFGNIVDEVAYHEKYPTIYHLRKKLVDSTDKADLRLIYLALAHM IKFRGHFLIEGDLNPDNSDVDKLFIQLVQTYNQLFEENPINASGVDAKAILSAR LSKSRRLENLIAQLPGEKKNGLFGNLIALSLGLTPNEKSNEDLAEDAKLQLSKD TYDDDLDNLLAQIGDQYADLFLAAKNLSDAILLSDILRVNTEITKAPLSASMIK RYDEHHQDLTLLKALVRQQLPEKYKEIFFDQSKNGYAGYIDGGASQEEFYKFIK PILEKMDGTEELLVKLNREDLLRKQRTFDNGSIPHQIHLGELHAILRRQEDFYP FLKDNREKIEKILTFRIPYYVGPLARGNSRFAWMTRKSEETITPWNFEEVVDKG ASAQSFIERMTNEDKNLPNEKVLPKHSLLYEYFTVYNELTKVKYVTEGMRKPAF LSGEQKKAIVDLLFKTNRKVTVKQLKEDYFKKIECFDSVEISGVEDRENASLGT YHDLLKIIKDKDELDNEENEDILEDIVLTLTLFEDREMIEERLKTYAHLEDDKV MKQLKRRRYTGWGRLSRKLINGIRDKQSGKTILDELKSDGFANRNFMQLIHDDS LTFKEDIQKAQVSGQGDSLHEHIANLAGSPAIKKGILQTVKVVDELVKVMGRHK PENIVIEMARENQTTQKGQKNSRERMKRIEEGIKELGSQILKEHPVENTQLQNE KLYLYYLQNGRDMYVDQELDINRLSDYDVDAIVPQSFLKDDSIDNKVLTRSDKN RGKSDNVPSEEVVKKMKNYWRQLLNAKLITQRKFDNLTKAERGGLSELDKAGFI KRQLVETRQITKHVAQILDSRMNTKYDENDKLIREVKVITLKSKLVSDERKDFQ FYKVREINNYHHAHDAYLNAVVGTALIKKYPKLESEFVYGDYKVYDVRKMIAKS EQEIGKATAKYFFYSNIMNFFKTEITLANGEIRKRPLIETNGETGEIVWDKGRD FATVRKVLSMPQVNIVKKTEVQTGGFSKESILPKRNSDKLIARKKDWDPKKYGG FDSPTVAYSVLVVAKVEKGKSKKLKSVKELLGITIMERSSFEKNPIDELEAKGY KEVKKDLIIKLPKYSLFELENGRKRMLASAGELQKGNELALPSKYVNFLYLASH YEKLKGSPEDNEQKQLFVEQHKHYLDEIIEQISEFSKRVILADANLDKVLSAYN KHRDKPIREQAENIIHLFTLTNLGAPAAFKYEDTTIDRKRYTSTKEVLDATLIH QSITGLYETRIDLSQLGGDSPKKKRKVGVDGSSGSETPGTSESATPESTGMNNS QGRVTFEDVTVNFTQGEWQRLNPEQRNLYRDVMLENYSNLVSVGQGETTKPDVI LRLEQGKEPWLEEEEVLGSRAEKNGDIGGQIWPKDVKESLSAPKKKRKVPKK KRKV |
| 1249 | gRNA #008 with updated modification pattern (m indicates a 2'-OMe modified nucleotide, * indicates a phosphorothioate bond) | mA*mG*mG*rArGrUrUrCrCrGrCrArGrUrArUrGrGrArUrGrUrUrUrUr ArGrArGmCmUmAmGmAmAmAmUmAmGmCrArArGrUrUrArArArArUrArAr GrGrCrUxArGrUrCrCrGrUxArUrCrAmAmCmUmUmGmAmAmAmAmAmGm UmGrGmCmAmCmCrGmAmGmUmCrGmGmUmGmCmU*mU*mU*mU |
| 1250 | CRISPR-Off variant 1 plasmid sequence | AGGGGCGCTCGAGCAGGTTCAGAAGGAGATCAAAAACCCCCAAGGATCAAACAT GAAGAGACCTGCTGCCACCAAGAAGGCCGGCCGGCCAAGAAAAAGTACAATCA CGATCAGGAGTTCGACCCCCCTAAGGTGTACCCACCAGTGCCTGCAGAGAAGAG GAAGCCAATCCGGGTGCTGAGCCTGTTTGATGGCATCGCCACCGGCCTGCTGGT GCTGAAGGATCTGGGCATCCAGGTGGACCGGTACATCGCCTCCGAGGTGTGCGA GGATTCTATCACCGTGGGCATGGTGCGCCACCAGGGCAAGATCATGTATGTGGG CGACGTGCGGTCCGTGACACAGAAGCACATCCAGGAGTGGGGCCCATTCGATCT GGTGATCGGCGGCAGCCCCTGTAATGACCTGTCCATCGTGAACCCTGCAAGGAA GGGACTGTACGAGGGAACCGGCCGGCTGTTCTTTGAGTTTTATAGACTGCTGCA CGACGCCAGGCCTAAGGAGGGCGACGATAGACCATTCTTTTGGCTGTTCGAGAA TGTGGTGGCTATGGGCGTGAGCGATAAGAGGGACATCTCCAGGTTTCTGGAGTC |

TABLE 18-continued

Sequence listing.

| SEQ | Description | Sequence |
|---|---|---|
| | | TAACCCCGTGATGATCGATGCAAAGGAGGTGTCCGCCGCACACAGAGCCAGGTA
TTTCTGGGGCAATCTGCCAGGAATGAACAGGCCACTGGCAAGCACCGTGAATGA
CAAGCTGGAGCTGCAGGAGTGCCTGGAGCACGGAAGGATCGCCAAGTTTTCCAA
GGTGCGCACAATCACCACACGGAGCAATTCCATCAAGCAGGGCAAGGATCAGCA
CTTCCCCGTGTTCATGAACGAGAAGGAGGACATCCTGTGGTGTACCGAGATGGA
GAGAGTGTTCGGCTTTCCAGTGCACTACACAGACGTGTCTAACATGAGCAGGCT
GGCAAGGCAGCGGCTGCTGGGCAGATCTTGGAGCGTGCCCGTGATCAGGCACCT
GTTCGCCCCTCTGAAGGAGTATTTTGCCTGCGTGAGCAGCGGCAACTCCAATGC
CAACAGCCGGGGCCCCTCTTTCAGCTCCGGATTGGTGCCTCTGAGCCTGAGGGG
CTCCCACAGTCCCCTTGAGATGTATAAAACTGTGCCTGTGTGGAAGAGAGAGCC
AGTGCGGGTGCTGTCCCTTTTTGGTGACATCAAGAAGAGCTGACGACTTTGGG
CTTTCTGGAAAACGGCTCTGACCCGGGCCGACTGAAACATTTGGACGATGTCAC
CAATACGGTGAGGAGGGACGTGGAAGAATGGGGCCCGTTCGACCTCGTGTACGG
CTCCACGCCGCCCCTCGGCCACGCCTGTGACCATCCTCCCGGGTGGTACCTGTT
CCAGTTCCACCGTGTGCTTCAGTACGCGAGGCCCAGGCCGGGCAGCCCGCAGGC
CTTCTTCTGGATGTTTGTGGACAACCTGGTGCTGACCGAGGATGACCGGGCTGT
AGCCACTCGCTTCCTGGAGACTGACCCGGTGACCATCCAGGACGTCTGTGGCAG
AGCTGTCCGGAACGCCGTGCACGTGTGGAGCAACATCCCGGCCGTGAAAAGCAG
GCACTCGGCCCTGTTTTCCCAGGAGGAATCATTCCTGCGGGCTCAGGACAGGCA
GAGAGCAAAGCCCCCCGCCCGGGGGCCAGCCAAGCTGGTGAAGAATTGTTTTCT
CCCCCTGAGAGAATATTTCAAGTATTTTTCAACAGAATTCACTTCCTCTTTGGG
AGGACCCTCCTCTGGCGCCCCACCACCTAGCGGCGGCTCCCCTGCCGGCTCTCC
AACCAGCACAGAGGAGGGCACCAGCGAGTCCGCCACACCAGAGTCTGGACCTGG
CACCAGCACAGAGCCATCCGAGGGCTCTGCCCCAGGCTCTCCTGCAGGCAGCCC
TACCTCCACCGAAGAGGGCACCAGCACAGAGCCTTCTGAGGGCAGCGCCCCAGG
CACCTCTACAGAGCCAAGCGAGCTCGAGGACAAGAAGTACAGCATCGGCCTGGC
CATCGGCACCAACTCTGTGGGCTGGGCCGTGATCACCGACGAGTACAAGGTGCC
CAGCAAGAAATTCAAGGTGCTGGGCAACACCGACCGGCACAGCATCAAGAAGAA
CCTGATCGGAGCCCTGCTGTTCGACAGCGGCGAAACAGCCGAGGCCACCCGGCT
GAAAGAACCGCCAGAAGAAGATACACCAGACGGAAGAACCGGATCTGCTATCT
GCAAGAGATCTTCAGCAACGAGATGGCCAAGGTGGACGACAGCTTCTTCCACAG
ACTGGAAGAGTCCTTCCTGGTGGAAGAGGATAAGAAGCACGAGCGGCACCCCAT
CTTCGGCAACATCGTGGACGAGGTGGCCTACCACGAGAAGTACCCCACCATCTA
CCACCTGAGAAAGAAACTGGTGGACAGCACCGACAAGGCCGACCTGCGGCTGAT
CTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCA
GACCTACAACCAGCTGTTCGAGGAAAACCCCATCAACGCCAGCGGCGTGGACGC
CAAGGCCATCCTGTCTGCCAGACTGAGCAAGAGCAGACGGCTGGAAAATCTGAT
CGCCCAGCTGCCCGGCGAGAAGAAGAATGGCCTGTTCGGCAACCTGATTGCCCT
GAGCCTGGGCCTGACCCCCAACTTCAAGAGCAACTTCGACCTGGCCGAGGATGC
CAAACTGCAGCTGAGCAAGGACACCTACGACGACGACCTGGACAACCTGCTGGC
CCAGATCGGCGACCAGTACGCCGACCTGTTTCTGGCCGCCAAGAACCTGTCCGA
CGCCATCCTGCTGAGCGACATCCTGAGAGTGAACACCGAGATCACCAAGGCCCC
CCTGAGCGCCTCTATGATCAAGAGATACGACGAGCACCACCAGGACCTGACCCT
GCTGAAAGCTCTCGTGCGGCAGCAGCTGCCTGAGAAGTACAAAGAGATTTTCTT
CGACCAGAGCAAGAACGGCTACGCCGGCTACATTGACGGCGGAGCCAGCCAGGA
AGAGTTCTACAAGTTCATCAAGCCCATCCTGGAAAAGATGGACGGCACCGAGGA
ACTGCTCGTGAAGCTGAACAGAGAGGACCTGCTGCGGAAGCAGCGGACCTTCGA
CAACGGCAGCATCCCCCACCAGATCCACCTGGGAGAGCTGCACGCCATTCTGCG
GCGGCAGGAAGATTTTTACCCATTCCTGAAGGACAACCGGGAAAAGATCGAGAA
GATCCTGACCTTCCGCATCCCCTACTACGTGGGCCCTCTGGCCAGGGGAAACAG
CAGATTCGCCTGGATGACCAGAAAGAGCGAGGAAACCATCACCCCCTGGAACTT
CGAGGAAGTGGTGGACAAGGGCGCTTCCGCCCAGAGCTTCATCGAGCGGATGAC
CAACTTCGATAAGAACCTGCCCAACGAGAAGGTGCTGCCCAAGCACAGCCTGCT
GTACGAGTACTTCACCGTGTATAACGAGCTGACCAAAGTGAAATACGTGACCGA
GGGAATGAGAAAGCCCGCCTTCCTGAGCGGCGAGCAGAAAAAGGCCATCGTGGA
CCTGCTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAGATCG
GTTCAACGCCTCCCTGGGCACATACCACGATCTGCTGAAAATTATCAAGGACAA
GGACTTCCTGGACAATGAGGAAAACGAGGACATTCTGGAAGATATCGTGCTGAC
CCTGACACTGTTTGAGGACAGAGAGATGATCGAGGAACGGCTGAAAACCTATGC
CCACCTGTTCGACGACAAAGTGATGAAGCAGCTGAAGCGGCGGAGATACACCGG
CTGGGGCAGGCTGAGCCGGAAGCTGATCAACGGCATCCGGGACAAGCAGTCCGG
CAAGACAATCCTGGATTTCCTGAAGTCCGACGGCTTCGCCAACAGAAACTTCAT
GCAGCTGATCCACGACGACAGCCTGACCTTTAAAGAGGACATCCAGAAAGCCCA
GGTGTCCGGCCAGGGCGATAGCCTGCACGAGCACATTGCCAATCTGGCCGGCAG
CCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGA
GAACCAGACCACCCAGAAGGGACAGAAGAACAGCCGCGAGAGAATGAAGCGGAT
CGAAGAGGGCATCAAAGAGCTGGGCAGCCAGATCCTGAAAGAACACCCCGTGGA
AAACACCCAGCTGCAGAACGAGAAGCTGTACCTGTACTACCTGCAGAATGGGCG
GGATATGTACGTGGACCAGGAACTGGACATCAACCGGCTGTCCGACTACGATGT
GGACGCCATCGTGCCTCAGAGCTTTTTGAAGGACGACTCCATCGACAACAAGGT
GCTGACCAGAAGCGACAAGAACCGGGGCAAGAGCGACAACGTGCCCTCCGAAGA
GGTCGTGAAGAAGATGAAGAACTACTGGCGGCAGCTGCTGAACGCCAAGCTGAT
TACCCAGAGAAAGTTCGACAATCTGACCAAGGCCGAGAGAGGCGGCCTGAGCGA |

TABLE 18-continued

Sequence listing.

| SEQ | Description | Sequence |
|---|---|---|
| | | ACTGGATAAGGCCGGCTTCATCAAGAGACAGCTGGTGGAAACCCGGCAGATCAC |
| | | AAAGCACGTGGCACAGATCCTGGACTCCCGGATGAACACTAAGTACGACGAGAA |
| | | TGACAAGCTGATCCGGGAAGTGAAAGTGATCACCCTGAAGTCCAAGCTGGTGTC |
| | | CGATTTCCGGAAGGATTTCCAGTTTTACAAAGTGCGCGAGATCAACAACTACCA |
| | | CCACGCCCACGACGCCTACCTGAACGCCGTCGTGGGAACCGCCCTGATCAAAAA |
| | | GTACCCTAAGCTGGAAAGCGAGTTCGTGTACGGCGACTACAAGGTGTACGACGT |
| | | GCGGAAGATGATCGCCAAGAGCGAGCAGGAAATCGGCAAGGCTACCGCCAAGTA |
| | | CTTCTTCTACAGCAACATCATGAACTTTTTCAAGACCGAGATTACCCTGGCCAA |
| | | CGGCGAGATCCGGAAGCGGCCTCTGATCGAGACAAACGGCGAAACCGGGGAGAT |
| | | CGTGTGGGATAAGGGCCGGGATTTTGCCACCGTGCGGAAAGTGCTGAGCATGCC |
| | | CCAAGTGAATATCGTGAAAAAGACCGAGGTGCAGACAGGCGGCTTCAGCAAAGA |
| | | GTCTATCCTGCCCAAGAGGAACAGCGATAAGCTGATCGCCAGAAAGAAGGACTG |
| | | GGACCCTAAGAAGTACGGCGGCTTCGACAGCCCCACCGTGGCCTATTCTGTGCT |
| | | GGTGGTGGCCAAAGTGGAAAAGGGCAAGTCCAAGAAACTGAAGAGTGTGAAAGA |
| | | GCTGCTGGGGATCACCATCATGGAAAGAAGCAGCTTCGAGAAGAATCCCATCGA |
| | | CTTTCTGGAAGCCAAGGGCTACAAAGAAGTGAAAAAGGACCTGATCATCAAGCT |
| | | GCCTAAGTACTCCCTGTTCGAGCTGGAAAACGGCCGGAAGAGAATGCTGGCCTC |
| | | TGCCGGCGAACTGCAGAAGGGAAACGAACTGGCCCTGCCCTCCAAATATGTGAA |
| | | CTTCCTGTACCTGGCCAGCCACTATGAGAAGCTGAAGGGCTCCCCCGAGGATAA |
| | | TGAGCAGAAACAGCTGTTTGTGGAACAGCACAAGCACTACCTGGACGAGATCAT |
| | | CGAGCAGATCAGCGAGTTCTCCAAGAGAGTGATCCTGGCCGACGCTAATCTGGA |
| | | CAAAGTGCTGTCCGCCTACAACAAGCACCGGGATAAGCCCATCAGAGAGCAGGC |
| | | CGAGAATATCATCCACCTGTTTACCCTGACCAATCTGGGAGCCCCTGCCGCCTT |
| | | CAAGTACTTTGACACCACCATCGACCGGAAGAGGTACACCAGCACCAAAGAGGT |
| | | GCTGGACGCCACCCTGATCCACCAGAGCATCACCGGCCTGTACGAGACACGGAT |
| | | CGACCTGTCTCAGCTGGGAGGCGACAGCCCCAAGAAGAAGAGAAAGGTGGGAGT |
| | | CGACGGATCCAGCGGCTCCGAGACCCCAGGCACATCTGAGAGCGCCACCCCTGA |
| | | GTCCACCGGTATGAACAATTCACAGGGGAGAGTGACATTCGAAGACGTGACCGT |
| | | GAACTTCACCCAGGGAGAATGGCAGCGCTTGAACCCAGAACAAAGGAACCTCTA |
| | | TCGGGACGTGATGCTGGAAAACTACTCAAATTTGGTGAGCGTTGGGCAGGGTGA |
| | | GACCACTAAGCCTGACGTGATCCTGAGATTGGAACAGGGCAAGGAGCCTTGGCT |
| | | CGAGGAAGAGGAAGTCCTGGGCTCAGGGAGGGCCGAGAAAAACGGTGATATAGG |
| | | AGGCCAGATATGGAAGCCTAAGGACGTCAAGGAGAGCCTGAGCGCTAAACGTCC |
| | | GGCAGCAACCAAAAAAGCAGGTCAGGCCAAGAAAAAATGAGGATCCTGAGTCTA |
| | | GAAAAGATATATATAGGATTGAAGATCTCTCAGTTAAGTCTACAAAAAAAAAAA |
| | | AAAAAAAAAAAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAAA |
| | | AAGAAGAGCCTCCTGCAGGAAGCTTGGCGTAATCATGGTCATAGCTGTTTCCTG |
| | | TGTGAAATTGTTATCCGCTCACAATTCCACACAACATACGAGCCGGAAGCATAA |
| | | AGTGTAAAGCCTGGGGTGCCTAATGAGTGAGCTAACTCACATTAATTGCGTTGC |
| | | GCTCACTGCCCGCTTTCCAGTCGGGAAACCTGTCGTGCCAGCTGCATTAATGAA |
| | | TCGGCCAACGCGCGGGGAGAGGCGGTTTGCGTATTGGGCGCTTCCTCGCTCAC |
| | | TGACTCGCTGCGCTCGGTCGTTCGGCTGCGGCGAGCGGTATCAGCTCACTCAAA |
| | | GGCGGTAATACGGTTATCCACAGAATCAGGGGATAACGCAGGAAAGAACATGTG |
| | | AGCAAAAGGCCAGCAAAAGGCCAGGAACCGTAAAAAGGCCGCGTTGCTGGCGTT |
| | | TTTCCATAGGCTCCGCCCCCCTGACGAGCATCACAAAAATCGACGCTCAAGTCA |
| | | GAGGTGGCGAAACCCGACAGGACTATAAAGATACCAGGCGTTTCCCCCTGGAAG |
| | | CTCCCTCGTGCGCTCTCCTGTTCCGACCCTGCCGCTTACCGGATACCTGTCCGC |
| | | CTTTCTCCCTTCGGGAAGCGTGGCGCTTTCTCATAGCTCACGCTGTAGGTATCT |
| | | CAGTTCGGTGTAGGTCGTTCGCTCCAAGCTGGGCTGTGTGCACGAACCCCCCGT |
| | | TCAGCCCGACCGCTGCGCCTTATCCGGTAACTATCGTCTTGAGTCCAACCCGGT |
| | | AAGACACGACTTATCGCCACTGGCAGCAGCCACTGGTAACAGGATTAGCAGAGC |
| | | GAGGTATGTAGGCGGTGCTACAGAGTTCTTGAAGTGGTGGCCTAACTACGGCTA |
| | | CACTAGAAGAACAGTATTTGGTATCTGCGCTCTGCTGAAGCCAGTTACCTTCGG |
| | | AAAAAGAGTTGGTAGCTCTTGATCCGGCAAACAAACCACCGCTGGTAGCGGTGG |
| | | TTTTTTTGTTTGCAAGCAGCAGATTACGCGCAGAAAAAAAGGATCTCAAGAAGA |
| | | TCCTTTGATCTTTTCTACGGGGTCTGACGCTCAGTGGAACGAAAACTCACGTTA |
| | | AGGGATTTTGGTCATGAGATTATCAAAAAGGATCTTCACCTAGATCCTTTTAAA |
| | | TTAAAAATGAAGTTTTAAATCAAGCCCAATCTGAATAATGTTACAACCAATTAA |
| | | CCAATTCTGATTAGAAAAACTCATCGAGCATCAAATGAAACTGCAATTTATTCA |
| | | TATCAGGATTATCAATACCATATTTTTGAAAAAGCCGTTTCTGTAATGAAGGAG |
| | | AAAACTCACCGAGGCAGTTCCATAGGATGGCAAGATCCTGGTATCGGTCTGCGA |
| | | TTCCGACTCGTCCAACATCAATACAACCTATTAATTTCCCCTCGTCAAAAATAA |
| | | GGTTATCAAGTGAGAAATCACCATGAGTGACGACTGAATCCGGTGAGAATGGCA |
| | | AAAGTTTATGCATTTCTTTCCAGACTTGTTCAACAGGCCAGCCATTACGCTCGT |
| | | CATCAAAATCACTCGCATCAACCAAACCGTTATTCATTCGTGATTGCGCCTGAG |
| | | CGAGACGAAATACGCGATCGCTGTTAAAAGGACAATTACAAACAGGAATCGAAT |
| | | GCAACCGGCGCAGGAACACTGCCAGCGCATCAACAATATTTTCACCTGAATCAG |
| | | GATATTCTTCTAATACCTGGAATGCTGTTTTTCCGGGGATCGCAGTGGTGAGTA |
| | | ACCATGCATCATCAGGAGTACGGATAAAATGCTTGATGGTCGGAAGAGGCATAA |
| | | ATTCCGTCAGCCAGTTTAGTCTGACCATCTCATCTGTAACATCATTGGCAACGC |
| | | TACCTTTGCCATGTTTCAGAAACAACTCTGGCGCATCGGGCTTCCCATACAAGC |
| | | GATAGATTGTCGCACCTGATTGCCCGACATTATCGCGAGCCCATTTATACCCAT |
| | | ATAAATCAGCATCCATGTTGGAATTTAATCGCGGCCTCGACGTTTCCCGTTGAA |
| | | TATGGCTCATAACACCCCTTGTATTACTGTTTATGTAAGCAGACAGTTTTATTG |
| | | TTCATGATGATATATTTTTATCTTGTGCAATGTAACATCAGAGATTTTGAGACA |

TABLE 18-continued

Sequence listing.

| SEQ | Description | Sequence |
|---|---|---|
| | | CGGGCCAGAGCTGCATCGCGCGTTTCGGTGATGACGGTGAAAACCTCTGACACA<br>TGCAGCTCCCGGAGACGGTCACAGCTTGTCTGTAAGCGGATGCCGGGAGCAGAC<br>AAGCCCGTCAGGGCGCGTCAGCGGGTGTTGGCGGGTGTCGGGGCTGGCTTAACT<br>ATGCGGCATCAGAGCAGATTGTACTGAGAGTGCACCATATGCGGTGTGAAATAC<br>CGCACAGATGCGTAAGGAGAAAATACCGCATCAGGCGCCATTCGCCATTCAGGC<br>TGCGCAACTGTTGGGAAGGGCGATCGGTGCGGGCCTCTTCGCTATTACGCCAGC<br>TGGCGAAAGGGGGATGTGCTGCAAGGCGATTAAGTTGGGTAACGCCAGGGTTTT<br>CCCAGTCACGACGTTGTAAAACGACGGCCAGTGAATTGTAATACGACTCACTAT<br>A |
| 1251 | CRISPR-Off variant 1 alternative plasmid sequence | AGGGGCGCTCGAGCAGGTTCAGAAGGAGATCAAAAACCCCCAAGGATCAAACAT<br>GAAGAGACCTGCTGCCACCAAGAAGGCCGGCCAGGCCAAGAAAAAGTACAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA<br>TGTGGTGGCTATGGGCGTGAGCGATAAGAGGGACATCTCCAGGTTTCTGGAGTC<br>TAACCCCGTGATGATCGATGCAAAGGAGGTGTCCGCCGCACACAGAGCCAGGTA<br>TTTCTGGGGCAATCTGCCAGGAATGAACAGGCCACTGGCAAGCACCGTGAATGA<br>CAAGCTGGAGCTGCAGGAGTGCCTGGAGCACGGAAGGATCGCCAAGTTTTCCAA<br>GGTGCGCACAATCACCACACGGAGCAATTCCATCAAGCAGGGCAAGGATCAGCA<br>CTTCCCCGTGTTCATGAACGAGAAGGAGGACATCCTGTGGTGTACCGAGATGGA<br>GAGAGTGTTCGGCTTTCCAGTGCACTACACAGACGTGTCTAACATGAGCAGGCT<br>GGCAAGGCAGCGGCTGCTGGGCAGATCTTGGAGCGTGCCCGTGATCAGGCACCT<br>GTTCGCCCCTCTGAAGGAGTATTTTGCCTGCGTGAGCAGCGGCAACTCCAATGC<br>CAACAGCCGGGGCCCCTCTTTCAGCTCCGGATTGGTGCCTCTGAGCCTGAGGGG<br>CTCCCACAGTCCCCTTGAGATGTATAAAACTGTGCCTGTGTGGAAGAGAGAGCC<br>AGTGCGGGTGCTGTCCCTTTTTGGTGACATCAAGAAAGAGCTGACGACTTTGGG<br>CTTTCTGGAAAACGGCTCTGACCCGGGCCGACTGAAACATTTGGACGATGTCAC<br>CAATACGGTGAGGAGGGACGTGGAAGAATGGGGCCCGTTCGACCTCGTGTACGG<br>CTCCACGCCGCCCCTCGGCCACGCCTGTGACCATCCTCCCGGGTGGTACCTGTT<br>CCAGTTCCACCGTGTGCTTCAGTACGCGAGGCCCAGGCCGGGCAGCCCGCAGGC<br>CTTCTTCTGGATGTTTGTGGACAACCTGGTGCTGACCGAGGATGACCGGGCTGT<br>AGCCACTCGCTTCCTGGAGACTGACCCGGTGACCATCCAGGACGTCTGTGGCAG<br>AGCTGTCCGGAACGCCGTGCACGTGTGGAGCAACATCCCGGCCGTGAAAAGCAG<br>GCACTCGGCCCTGTTTTCCCAGGAGGAATCATTCCTGCGGGCTCAGGACAGGCA<br>GAGAGCAAAGCCCCCGCCCGGGGGCCAGCCAAGCTGGTGAAGAATTGTTTTCT<br>CCCCCTGAGAGAATATTTCAAGTATTTTTCAACAGAATTCACTTCCTCTTTGGG<br>AGGACCCTCCTCTGGCGCCCCACCACCTAGCGGCGGCTCCCCTGCCGGCTCTCC<br>AACCAGCACAGAGGAGGGCACCAGCGAGTCCGCCACACCAGAGTCTGGACCTGG<br>CACCAGCACAGAGCCATCCGAGGGCTCTGCCCCAGGCTCTCCTGCAGGCAGCCC<br>TACCTCCACCGAAGAGGGCACCAGCACAGAGCCTTCTGAGGGCAGCGCCCCAGG<br>CACCTCTACAGAGCCAAGCGAGCTCGAGGACAAGAAGTACAGCATCGGCCTGGC<br>CATCGGCACCAACTCTGTGGGCTGGGCCGTGATCACCGACGAGTACAAGGTGCC<br>CAGCAAGAAATTCAAGGTGCTGGGCAACACCGACCGGCACAGCATCAAGAAGAA<br>CCTGATCGGAGCCCTGCTGTTCGACAGCGGCGAAACAGCCGAGGCCACCCGGCT<br>GAAGAGAACCGCCAGAAGAAGATACACCAGACGGAAGAACCGGATCTGCTATCT<br>GCAAGAGATCTTCAGCAACGAGATGGCCAAGGTGGACGACAGCTTCTTCCACAG<br>ACTGGAAGAGTCCTTCCTGGTGGAAGAGGATAAGAAGCACGAGCGGCACCCCAT<br>CTTCGGCAACATCGTGGACGAGGTGGCCTACCACGAGAAGTACCCCACCATCTA<br>CCACCTGAGAAAGAAACTGGTGGACAGCACCGACAAGGCCGACCTGCGGCTGAT<br>CTATCTGGCCCTGGCCCACATGATCAAGTTCCGGGGCCACTTCCTGATCGAGGG<br>CGACCTGAACCCCGACAACAGCGACGTGGACAAGCTGTTCATCCAGCTGGTGCA<br>GACCTACAACCAGCTGTTCGAGGAAAACCCCATCAACGCCAGCGGCGTGGACGC<br>CAAGGCCATCCTGTCTGCCAGACTGAGCAAGAGCAGACGGCTGGAAAATCTGAT<br>CGCCCAGCTGCCCGGCGAGAAGAAGAATGGCCTGTTCGGCAACCTGATTGCCCT<br>GAGCCTGGGCCTGACCCCCAACTTCAAGAGCAACTTCGACCTGGCCGAGGATGC<br>CAAACTGCAGCTGAGCAAGGACACCTACGACGACGACCTGGACAACCTGCTGGC<br>CCAGATCGGCGACCAGTACGCCGACCTGTTTCTGGCCGCCAAGAACCTGTCCGA<br>CGCCATCCTGCTGAGCGACATCCTGAGAGTGAACACCGAGATCACCAAGGCCCC<br>CCTGAGCGCCTCTATGATCAAGAGATACGACGAGCACCACCAGGACCTGACCCT<br>GCTGAAAGCTCTCGTGCGGCAGCAGCTGCCTGAGAAGTACAAAGAGATTTTCTT<br>CGACCAGAGCAAGAACGGCTACGCCGGCTACATTGACGGCGGAGCCAGCCAGGA<br>AGAGTTCTACAAGTTCATCAAGCCCATCCTGGAAAAGATGGACGGCACCGAGGA<br>ACTGCTCGTGAAGCTGAACAGAGAGGACCTGCTGCGGAAGCAGCGGACCTTCGA<br>CAACGGCAGCATCCCCCACCAGATCCACCTGGGAGAGCTGCACGCCATTCTGCG<br>GCGGCAGGAAGATTTTTACCCATTCCTGAAGGACAACCGGGAAAAGATCGAGAA<br>GATCCTGACCTTCCGCATCCCCTACTACGTGGGCCCTCTGGCCAGGGGAAACAG<br>CAGATTCGCCTGGATGACCAGAAAGAGCGAGGAAACCATCACCCCCTGGAACTT<br>CGAGGAAGTGGTGGACAAGGGCGCTTCCGCCCAGAGCTTCATCGAGCGGATGAC<br>CAACTTCGATAAGAACCTGCCCAACGAGAAGGTGCTGCCCAAGCACAGCCTGCT<br>GTACGAGTACTTCACCGTGTATAACGAGCTGACCAAAGTGAAATACGTGACCGA |

TABLE 18-continued

Sequence listing.

| SEQ | Description | Sequence |
|---|---|---|
| | | GGGAATGAGAAAGCCCGCCTTCCTGAGCGGCGAGCAGAAAAAGGCCATCGTGGA |
| | | CCTGCTGTTCAAGACCAACCGGAAAGTGACCGTGAAGCAGCTGAAAGAGGACTA |
| | | CTTCAAGAAAATCGAGTGCTTCGACTCCGTGGAAATCTCCGGCGTGGAAGATCG |
| | | GTTCAACGCCTCCCTGGGCACATACCACGATCTGCTGAAAATTATCAAGGACAA |
| | | GGACTTCCTGGACAATGAGGAAAACGAGGACATTCTGGAAGATATCGTGCTGAC |
| | | CCTGACACTGTTTGAGGACAGAGAGATGATCGAGGAACGGCTGAAAACCTATGC |
| | | CCACCTGTTCGACGACAAAGTGATGAAGCAGCTGAAGCGGCGGAGATACACCGG |
| | | CTGGGGCAGGCTGAGCCGGAAGCTGATCAACGGCATCCGGGACAAGCAGTCCGG |
| | | CAAGACAATCCTGGATTTCCTGAAGTCCGACGGCTTCGCCAACAGAAACTTCAT |
| | | GCAGCTGATCCACGACGACAGCCTGACCTTTAAAGAGGACATCCAGAAAGCCCA |
| | | GGTGTCCGGCCAGGGCGATAGCCTGCACGAGCACATTGCCAATCTGGCCGGCAG |
| | | CCCCGCCATTAAGAAGGGCATCCTGCAGACAGTGAAGGTGGTGGACGAGCTCGT |
| | | GAAAGTGATGGGCCGGCACAAGCCCGAGAACATCGTGATCGAAATGGCCAGAGA |
| | | GAACCAGACCACCCAGAAGGGACAGAAGAACAGCCGCGAGAGAATGAAGCGGAT |
| | | CGAAGAGGGCATCAAAGAGCTGGGCAGCCAGATCCTGAAAGAACACCCCGTGGA |
| | | AAACACCCAGCTGCAGAACGAGAAGCTGTACCTGTACTACCTGCAGAATGGGCG |
| | | GGATATGTACGTGGACCAGGAACTGGACATCAACCGGCTGTCCGACTACGATGT |
| | | GGACGCCATCGTGCCTCAGAGCTTTCTGAAGGACGACTCCATCGACAACAAGGT |
| | | GCTGACCAGAAGCGACAAGAACCGGGGCAAGAGCGACAACGTGCCCTCCGAAGA |
| | | GGTCGTGAAGAAGATGAAGAACTACTGGCGGCAGCTGCTGAACGCCAAGCTGAT |
| | | TACCCAGAGAAAGTTCGACAATCTGACCAAGGCCGAGAGAGGCGGCCTGAGCGA |
| | | ACTGGATAAGGCCGGCTTCATCAAGAGACAGCTGGTGGAAACCCGGCAGATCAC |
| | | AAAGCACGTGGCACAGATCCTGGACTCCCGGATGAACACTAAGTACGACGAGAA |
| | | TGACAAGCTGATCCGGGAAGTGAAAGTGATCACCCTGAAGTCCAAGCTGGTGTC |
| | | CGATTTCCGGAAGGATTTCCAGTTTTACAAAGTGCGCGAGATCAACAACTACCA |
| | | CCACGCCCACGACGCCTACCTGAACGCCGTCGTGGGAACCGCCCTGATCAAAAA |
| | | GTACCCTAAGCTGGAAAGCGAGTTCGTGTACGGCGACTACAAGGTGTACGACGT |
| | | GCGGAAGATGATCGCCAAGAGCGAGCAGGAAATCGGCAAGGCTACCGCCAAGTA |
| | | CTTCTTCTACAGCAACATCATGAACTTTTTCAAGACCGAGATTACCCTGGCCAA |
| | | CGGCGAGATCCGGAAGCGGCCTCTGATCGAGACAAACGGCGAAACCGGGGAGAT |
| | | CGTGTGGGATAAGGGCCGGGATTTTGCCACCGTGCGGAAAGTGCTGAGCATGCC |
| | | CCAAGTGAATATCGTGAAAAAGACCGAGGTGCAGACAGGCGGCTTCAGCAAAGA |
| | | GTCTATCCTGCCCAAGAGGAACAGCGATAAGCTGATCGCCAGAAAGAAGGACTG |
| | | GGACCCTAAGAAGTACGGCGGCTTCGACAGCCCCACCGTGGCCTATTCTGTGCT |
| | | GGTGGTGGCCAAAGTGGAAAAGGGCAAGTCCAAGAAACTGAAGAGTGTGAAAGA |
| | | GCTGCTGGGGATCACCATCATGGAAAGAAGCAGCTTCGAGAAGAATCCCATCGA |
| | | CTTTCTGGAAGCCAAGGGCTACAAAGAAGTGAAAAAGGACCTGATCATCAAGCT |
| | | GCCTAAGTACTCCCTGTTCGAGCTGGAAAACGGCCGGAAGAGAATGCTGGCCTC |
| | | TGCCGGCGAACTGCAGAAGGGAAACGAACTGGCCCTGCCCTCCAAATATGTGAA |
| | | CTTCCTGTACCTGGCCAGCCACTATGAGAAGCTGAAGGGCTCCCCCGAGGATAA |
| | | TGAGCAGAAACAGCTGTTTGTGGAACAGCACAAGCACTACCTGGACGAGATCAT |
| | | CGAGCAGATCAGCGAGTTCTCCAAGAGAGTGATCCTGGCCGACGCTAATCTGGA |
| | | CAAAGTGCTGTCCGCCTACAACAAGCACCGGGATAAGCCCATCAGAGAGCAGGC |
| | | CGAGAATATCATCCACCTGTTTACCCTGACCAATCTGGGAGCCCCTGCCGCCTT |
| | | CAAGTACTTTGACACCACCATCGACCGGAAGAGGTACACCAGCACCAAAGAGGT |
| | | GCTGGACGCCACCCTGATCCACCAGAGCATCACCGGCCTGTACGAGACACGGAT |
| | | CGACCTGTCTCAGCTGGGAGGCGACAGCCCCAAGAAGAAGAGAAAGGTGGGAGT |
| | | CGACGGATCCAGCGGCTCCGAGACCCCAGGCACATCTGAGAGCGCCACCCCTGA |
| | | GTCCACCGGTATGAACAATTCACAGGGGAGAGTGACATTCGAAGACGTGACCGT |
| | | GAACTTCACCCAGGGAGAATGGCAGCGCTTGAACCCAGAACAAAGGAACCTCTA |
| | | TCGGGACGTGATGCTGGAAAACTACTCAAATTTGGTGAGCGTTGGGCAGGGTGA |
| | | GACCACTAAGCCTGACGTGATCCTGAGATTGGAACAGGGCAAGGAGCCTTGGCT |
| | | CGAGGAAGAGGAAGTCCTGGGCTCAGGGAGGGCCGAGAAAAACGGTGATATAGG |
| | | AGGCCAGATATGGAAGCCTAAGGACGTCAAGGAGGCCTGAGCGCTAAACGTCC |
| | | GGCAGCAACCAAAAAAGCAGGTCAGGCCAAGAAAAAATGAGGATCCTGAGTCTA |
| | | GAAAAGATATATATAGGATTGAAGATCTCTCAGTTAAGTCTACAAAAAAAAAAA |
| | | AAAAAAAAAAAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAAA |
| | | AAGAAGAGCGAATTCACTGGCCGTCGTTTTACAACGTCGTGACTGGGAAAACCC |
| | | TGGCGTTACCCAACTTAATCGCCTTGCAGCACATCCCCCTTTCGCCAGCTGGCG |
| | | TAATAGCGAAGAGGCCCGCACCGATCGCCCTTCCCAACAGTTGCGCAGCCTGAA |
| | | TGGCGAATGGCGCCTGATGCGGTATTTTCTCCTTACGCATCTGTGCGGTATTTC |
| | | ACACCGCATATGGTGCACTCTCAGTACAATCTGCTCTGATGCCGCATAGTTAAG |
| | | CCAGCCCCGACACCCGCCAACACCCGCTGACGCGCCCTGACGGGCTTGTCTGCT |
| | | CCCGGCATCCGCTTACAGACAAGCTGTGACCGTCTCCGGGAGCTGCATGTGTCA |
| | | GAGGTTTTCACCGTCATCACCGAAACGCGCGATGCAGCTCTGGCCCGTGTCTCA |
| | | AAATCTCTGATGTTACATTGCACAAGATAAAAATATATCATCATGAACAATAAA |
| | | ACTGTCTGCTTACATAAACAGTAATACAAGGGGTGTTATGAGCCATATTCAACG |
| | | GGAAACGTCGAGGCCGCGATTAAATTCCAACATGGATGCTGATTTATATGGGTA |
| | | TAAATGGGCTCGCGATAATGTCGGGCAATCAGGTGCGACAATCTATCGCTTGTA |
| | | TGGGAAGCCCGATGCGCCAGAGTTGTTTCTGAAACATGGCAAAGGTAGCGTTGC |
| | | CAATGATGTTACAGATGAGATGGTCAGACTAAACTGGCTGACGGAATTTATGCC |
| | | TCTTCCGACCATCAAGCATTTTATCCGTACTCCTGATGATGCATGGTTACTCAC |
| | | CACTGCGATCCCCGGAAAAACAGCATTCCAGGTATTAGAAGAATATCCTGATTC |
| | | AGGTGAAAATATTGTTGATGCGCTGGCAGTGTTCCTGCGCCGGTTGCATTCGAT |
| | | TCCTGTTTGTAATTGTCCTTTTAACAGCGATCGCGTATTTCGTCTCGCTCAGGC |

TABLE 18-continued

Sequence listing.

| SEQ | Description | Sequence |
|---|---|---|
| | | GCAATCACGAATGAATAACGGTTTGGTTGATGCGAGTGATTTTGATGACGAGCG<br>TAATGGCTGGCCTGTTGAACAAGTCTGGAAAGAAATGCATAAACTTTTGCCATT<br>CTCACCGGATTCAGTCGTCACTCATGGTGATTTCTCACTTGATAACCTTATTTT<br>TGACGAGGGGAAATTAATAGGTTGTATTGATGTTGGACGAGTCGGAATCGCAGA<br>CCGATACCAGGATCTTGCCATCCTATGGAACTGCCTCGGTGAGTTTTCTCCTTC<br>ATTACAGAAACGGCTTTTTCAAAAATATGGTATTGATAATCCTGATATGAATAA<br>ATTGCAGTTTCATTTGATGCTCGATGAGTTTTTCTAATCAGAATTGGTTAATTG<br>GTTGTAACATTATTCAGATTGGGCTTGATTTAAAACTTCATTTTTAATTTAAAA<br>GGATCTAGGTGAAGATCCTTTTTGATAATCTCATGACCAAAATCCCTTAACGTG<br>AGTTTTCGTTCCACTGAGCGTCAGACCCCGTAGAAAAGATCAAAGGATCTTCTT<br>GAGATCCTTTTTTTCTGCGCGTAATCTGCTGCTTGCAAACAAAAAAACCACCGC<br>TACCAGCGGTGGTTTGTTTGCCGGATCAAGAGCTACCAACTCTTTTTCCGAAGG<br>TAACTGGCTTCAGCAGAGCGCAGATACCAAATACTGTTCTTCTAGTGTAGCCGT<br>AGTTAGGCCACCACTTCAAGAACTCTGTAGCACCGCCTACATACCTCGCTCTGC<br>TAATCCTGTTACCAGTGGCTGCTGCCAGTGGCGATAAGTCGTGTCTTACCGGGT<br>TGGACTCAAGACGATAGTTACCGGATAAGGCGCAGCGGTCGGGCTGAACGGGGG<br>GTTCGTGCACACAGCCCAGCTTGGAGCGAACGACCTACACCGAACTGAGATACC<br>TACAGCGTGAGCTATGAGAAAGCGCCACGCTTCCCGAAGGGAGAAAGGCGGACA<br>GGTATCCGGTAAGCGGCAGGGTCGGAACAGGAGAGCGCACGAGGGAGCTTCCAG<br>GGGGAAACGCCTGGTATCTTTATAGTCCTGTCGGGTTTCGCCACCTCTGACTTG<br>AGCGTCGATTTTTGTGATGCTCGTCAGGGGGGCGGAGCCTATGGAAAAACGCCA<br>GCAACGCGGCCTTTTTACGGTTCCTGGCCTTTTGCTGGCCTTTTGCTCACATGT<br>TCTTTCCTGCGTTATCCCCTGATTCTGTGGATAACCGTATTACCGCCTTTGAGT<br>GAGCTGATACCGCTCGCCGCAGCCGAACGACCGAGCGCAGCGAGTCAGTGAGCG<br>AGGAAGCGGCCAATACGCAAACCGCCTCTCCCCGCGCGTTGGCCGATTCATTA<br>ATGCAGCTGGCACGACAGGTTTCCCGACTGGAAAGCGGGCAGTGAGCGCAACGC<br>AATTAATGTGAGTTAGCTCACTCATTAGGCACCCCAGGCTTTACACTTTATGCT<br>TCCGGCTCGTATGTTGTGTGGAATTGTGAGCGGATAACAATTTCACACAGGAAA<br>CAGCTATGACCATGATTACGCCAAGCTTAATACGACTCACTATA |
| 1252 | CRISPR-Off<br>variant 1 amino<br>acid sequence | MKRPAATKKAGQAKKKYNHDQEFDPPKVYPPVPAEKRKPIRVLSLEDGIATGLL<br>VLKDLGIQVDRYIASEVCEDSITVGMVRHQGKIMYVGDVRSVTQKHIQEWGPED<br>LVIGGSPCNDLSIVNPARKGLYEGTGRLFFEFYRLLHDARPKEGDDRPFFWLFE<br>NVVAMGVSDKRDISRFLESNPVMIDAKEVSAAHRARYFWGNLPGMNRPLASTVN<br>DKLELQECLEHGRIAKFSKVRTITTRSNSIKQGKDQHFPVEMNEKEDILWCTEM<br>ERVFGFPVHYTDVSNMSRLARQRLLGRSWSVPVIRHLFAPLKEYFACVSSGNSN<br>ANSRGPSFSSGLVPLSLRGSHSPLEMYKTVPVWKREPVRVLSLFGDIKKELTTL<br>GFLENGSDPGRLKHLDDVTNTVRRDVEEWGPFDLVYGSTPPLGHACDHPPGWYL<br>FQFHRVLQYARPRPGSPQAFFWMFVDNLVLTEDDRAVATRFLETDPVTIQDVCG<br>RAVRNAVHVWSNIPAVKSRHSALESQEESFLRAQDRQRAKPPARGPAKLVKNCF<br>LPLREYFKYESTEFTSSLGGPSSGAPPPSGGSPAGSPTSTEEGTSESATPESGP<br>GTSTEPSEGSAPGSPAGSPTSTEEGTSTEPSEGSAPGTSTEPSELEDKKYSIGL<br>AIGTNSVGWAVITDEYKVPSKKFKVLGNTDRHSIKKNLIGALLEDSGETAEATR<br>LKRTARRRYTRRKNRICYLQEIFSNEMAKVDDSFFHRLEESELVEEDKKHERHP<br>IFGNIVDEVAYHEKYPTIYHLRKKLVDSTDKADLRLIYLALAHMIKERGHFLIE<br>GDLNPDNSDVDKLFIQLVQTYNQLFEENPINASGVDAKAILSARLSKSRRLENL<br>IAQLPGEKKNGLFGNLIALSLGLTPNEKSNFDLAEDAKLQLSKDTYDDDLDNLL<br>AQIGDQYADLFLAAKNLSDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTEDNGSIPHQIHLGELHAILRRQEDFYPELKDNREKIE<br>KILTFRIPYYVGPLARGNSRFAWMTRKSEETITPWNFEEVVDKGASAQSFIERM<br>TNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRENASLGTYHDLLKIIKD<br>KDFLDNEENEDILEDIVLTLTLFEDREMIEERLKTYAHLEDDKVMKQLKRRRYT<br>GWGRLSRKLINGIRDKQSGKTILDELKSDGFANRNEMQLIHDDSLTFKEDIQKA<br>QVSGQGDSLHEHIANLAGSPAIKKGILQTVKVVDELVKVMGRHKPENIVIEMAR<br>ENQTTQKGQKNSRERMKRIEEGIKELGSQILKEHPVENTQLQNEKLYLYYLQNG<br>RDMYVDQELDINRLSDYDVDAIVPQSFLKDDSIDNKVLTRSDKNRGKSDNVPSE<br>EVVKKMKNYWRQLLNAKLITQRKEDNLTKAERGGLSELDKAGFIKRQLVETRQI<br>TKHVAQILDSRMNTKYDENDKLIREVKVITLKSKLVSDERKDFQFYKVREINNY<br>HHAHDAYLNAVVGTALIKKYPKLESEFVYGDYKVYDVRKMIAKSEQEIGKATAK<br>YFFYSNIMNFFKTEITLANGEIRKRPLIETNGETGEIVWDKGRDFATVRKVLSM<br>PQVNIVKKTEVQTGGFSKESILPKRNSDKLIARKKDWDPKKYGGEDSPTVAYSV<br>LVVAKVEKGKSKKLKSVKELLGITIMERSSFEKNPIDFLEAKGYKEVKKDLIIK<br>LPKYSLFELENGRKRMLASAGELQKGNELALPSKYVNFLYLASHYEKLKGSPED<br>NEQKQLFVEQHKHYLDEIIEQISEFSKRVILADANLDKVLSAYNKHRDKPIREQ<br>AENIIHLFTLTNLGAPAAFKYFDTTIDRKRYTSTKEVLDATLIHQSITGLYETR<br>IDLSQLGGDSPKKKRKVGVDSSGSETPGTSESATPESTGMNNSQGRVTFEDVT<br>VNFTQGEWQRLNPEQRNLYRDVMLENYSNLVSVGQGETTKPDVILRLEQGKEPW<br>LEEEEVLGSGRAEKNGDIGGQIWKPKDVKESLSAKRPAATKKAGQAKKK |
| 1253 | CRISPR-Off<br>variant 2 plasmid<br>sequence | AGAAACTAGCGTAAATTCAAATATAGGTCAGGCTTCAACGTCAACAAATATGAT<br>GAAGAGACCTGCTGCCACCAAGAAGGCCGGCCAGGCCAAGAAAAAGTACAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA |

TABLE 18-continued

Sequence listing.

| SEQ | Description | Sequence |
|---|---|---|
| | | GGATTCTATCACCGTGGGCATGGTGCGCCACCAGGGCAAGATCATGTATGTGGG |
| | | CGACGTGCGGTCCGTGACACAGAAGCACATCCAGGAGTGGGGCCCATTCGATCT |
| | | GGTGATCGGCGGCAGCCCCTGTAATGACCTGTCCATCGTGAACCCTGCAAGGAA |
| | | GGGACTGTACGAGGGAACCGGCCGGCTGTTCTTTGAGTTTTATAGACTGCTGCA |
| | | CGACGCCAGGCCTAAGGAGGGCGACGATAGACCATTCTTTTGGCTGTTCGAGAA |
| | | TGTGGTGGCTATGGGCGTGAGCGATAAGAGGGACATCTCCAGGTTTCTGGAGTC |
| | | TAACCCCGTGATGATCGATGCAAAGGAGGTGTCCGCCGCACACAGAGCCAGGTA |
| | | TTTCTGGGGCAATCTGCCAGGAATGAACAGGCCACTGGCAAGCACCGTGAATGA |
| | | CAAGCTGGAGCTGCAGGAGTGCCTGGAGCACGGAAGGATCGCCAAGTTTTCCAA |
| | | GGTGCGCACAATCACCACACGGAGCAATTCCATCAAGCAGGGCAAGGATCAGCA |
| | | CTTCCCCGTGTTCATGAACGAGAAGGAGGACATCCTGTGGTGTACCGAGATGGA |
| | | GAGAGTGTTCGGCTTTCCAGTGCACTACACAGACGTGTCTAACATGAGCAGGCT |
| | | GGCAAGGCAGCGGCTGCTGGGCAGATCTTGGAGCGTGCCCGTGATCAGGCACCT |
| | | GTTCGCCCCTCTGAAGGAGTATTTTGCCTGCGTGAGCAGCGGCAACTCCAATGC |
| | | CAACAGCCGGGGCCCCTCTTTCAGCTCCGGATTGGTGCCTCTGAGCCTGAGGGG |
| | | CTCCCACAGCCCTATGGAGATATACAAGACAGTGTCTGCATGGAAGAGACAGCC |
| | | AGTGAGGGTGCTGAGCCTTTTTGGGAATATTGATAAAGAACTAAAGAGTTTGGG |
| | | CTTTTTGGAAATCGGTTCTGATTCTGAGGGAGGAACACTGAAGTACGTGGAAGA |
| | | TGTCACGAATGTCGTGAGGAGAGACGTGGAGAAATGGGGCCCCTTTGACCTGGT |
| | | GTATGGCTCGACGAATCCCCTAGGCAACTCTTGTGACCGCTGTCCTGGCTGGTA |
| | | CATGTTCCAATTCCACCGGATCCTGCAGTATGCGCGGCCTCGCCAAGACAGTCA |
| | | GAAGCCCTTCTTCTGGATATTTATGGACAATCTGCTGCTGACTGAGGATGATCA |
| | | AGTGACAACTGTCCGCTTCCTTCAGACAGAGGCTGTGACCCTCCAGGATGTCCG |
| | | TGGCAGAGTCCTCCAGAATGCTGTGAGGGTATGGAGCAACATTCCAGGACTGAA |
| | | GAGTAAGCACTCAGTCCTGACGCCAAAGGAAGAACAGTCTCTGCAAGCCCAAGT |
| | | CAGAACCAGAAGCAAGCTGCCCACCCAGGTTAACCCCCTGGTGAAGACCTGCCT |
| | | TCTCCCCCTGAGAGAGTACTTCAAGTGTTTTTCTCAGAATTCACTTCCTCTTGG |
| | | AGGACCCTCCTCTGGCGCCCCACCACCTAGCGGCGGCTCCCCTGCCGGCTCTCC |
| | | AACCAGCACAGAGGAGGGCACCAGCGAGTCCGCCACACCAGAGTCTGGACCTGG |
| | | CACCAGCACAGAGCCATCCGAGGGCTCTGCCCCAGGCTCTCCTGCAGGCAGCCC |
| | | TACCTCCACCGAAGAGGGCACCAGCACAGAGCCTTCTGAGGGCAGCGCCCCAGG |
| | | CACCTCTACAGAGCCAAGCGAGCTCGAGGACAAGAAGTACAGCATCGGCCTGGC |
| | | CATCGGCACCAACTCTGTGGGCTGGGCCGTGATCACCGACGAGTACAAGGTGCC |
| | | CAGCAAGAAATTCAAGGTGCTGGGCAACACCGACCGGCACAGCATCAAGAAGAA |
| | | CCTGATCGGAGCCCTGCTGTTCGACAGCGGCGAAACAGCCGAGGCCACCCGGCT |
| | | GAAGAGAACCGCCAGAAGAAGATACACCAGACGGAAGAACCGGATCTGCTATCT |
| | | GCAAGAGATCTTCAGCAACGAGATGGCCAAGGTGGACGACAGCTTCTTCCACAG |
| | | ACTGGAAGAGTCCTTCCTGGTGGAAGAGGATAAGAAGCACGAGCGGCACCCCAT |
| | | CTTCGGCAACATCGTGGACGAGGTGGCCTACCACGAGAAGTACCCCACCATCTA |
| | | CCACCTGAGAAAGAAACTGGTGGACAGCACCGACAAGGCCGACCTGCGGCTGAT |
| | | CTATCTGGCCCTGGCCCACATGATCAAGTTCCGGGGCCACTTCCTGATCGAGGG |
| | | CGACCTGAACCCCGACAACAGCGACGTGGACAAGCTGTTCATCCAGCTGGTGCA |
| | | GACCTACAACCAGCTGTTCGAGGAAAACCCCATCAACGCCAGCGGCGTGGACGC |
| | | CAAGGCCATCCTGTCTGCCAGACTGAGCAAGAGCAGACGGCTGGAAAATCTGAT |
| | | CGCCCAGCTGCCCGGCGAGAAGAAGAATGGCCTGTTCGGCAACCTGATTGCCCT |
| | | GAGCCTGGGCCTGACCCCCAACTTCAAGAGCAACTTCGACCTGGCCGAGGATGC |
| | | CAAACTGCAGCTGAGCAAGGACACCTACGACGACGACCTGGACAACCTGCTGGC |
| | | CCAGATCGGCGACCAGTACGCCGACCTGTTTCTGGCCGCCAAGAACCTGTCCGA |
| | | CGCCATCCTGCTGAGCGACATCCTGAGAGTGAACACCGAGATCACCAAGGCCCC |
| | | CCTGAGCGCCTCTATGATCAAGAGATACGACGAGCACCACCAGGACCTGACCCT |
| | | GCTGAAAGCTCTCGTGCGGCAGCAGCTGCCTGAGAAGTACAAAGAGATTTTCTT |
| | | CGACCAGAGCAAGAACGGCTACGCCGGCTACATTGACGGCGGAGCCAGCCAGGA |
| | | AGAGTTCTACAAGTTCATCAAGCCCATCCTGGAAAAGATGGACGGCACCGAGGA |
| | | ACTGCTCGTGAAGCTGAACAGAGAGGACCTGCTGCGGAAGCAGCGGACCTTCGA |
| | | CAACGGCAGCATCCCCCACCAGATCCACCTGGGAGAGCTGCACGCCATTCTGCG |
| | | GCGGCAGGAAGATTTTTACCCATTCCTGAAGGACAACCGGGAAAAGATCGAGAA |
| | | GATCCTGACCTTCCGCATCCCCTACTACGTGGGCCCTCTGGCCAGGGGAAACAG |
| | | CAGATTCGCCTGGATGACCAGAAAGAGCGAGGAAACCATCACCCCCTGGAACTT |
| | | CGAGGAAGTGGTGGACAAGGGCGCTTCCGCCCAGAGCTTCATCGAGCGGATGAC |
| | | CAACTTCGATAAGAACCTGCCCAACGAGAAGGTGCTGCCCAAGCACAGCCTGCT |
| | | GTACGAGTACTTCACCGTGTATAACGAGCTGACCAAAGTGAAATACGTGACCGA |
| | | GGGAATGAGAAAGCCCGCCTTCCTGAGCGGCGAGCAGAAAAAGGCCATCGTGGA |
| | | CCTGCTGTTCAAGACCAACCGGAAAGTGACCGTGAAGCAGCTGAAAGAGGACTA |
| | | CTTCAAGAAAATCGAGTGCTTCGACTCCGTGGAAATCTCCGGCGTGGAAGATCG |
| | | GTTCAACGCCTCCCTGGGCACATACCACGATCTGCTGAAAATTATCAAGGACAA |
| | | GGACTTCCTGGACAATGAGGAAAACGAGGACATTCTGGAAGATATCGTGCTGAC |
| | | CCTGACACTGTTTGAGGACAGAGAGATGATCGAGGAACGGCTGAAAACCTATGC |
| | | CCACCTGTTCGACGACAAAGTGATGAAGCAGCTGAAGCGGCGGAGATACACCGG |
| | | CTGGGGCAGGCTGAGCCGGAAGCTGATCAACGGCATCCGGGACAAGCAGTCCGG |
| | | CAAGACAATCCTGGATTTCCTGAAGTCCGACGGCTTCGCCAACAGAAACTTCAT |
| | | GCAGCTGATCCACGACGACAGCCTGACCTTTAAAGAGGACATCCAGAAAGCCCA |
| | | GGTGTCCGGCCAGGGCGATAGCCTGCACGAGCACATTGCCAATCTGGCCGGCAG |
| | | CCCCGCCATTAAGAAGGGCATCCTGCAGACAGTGAAGGTGGTGGACGAGCTCGT |
| | | GAAAGTGATGGGCCGGCACAAGCCCGAGAACATCGTGATCGAAATGGCCAGAGA |
| | | GAACCAGACCACCCAGAAGGGACAGAAGAACAGCCGCGAGAGAATGAAGCGGAT |
| | | CGAAGAGGGCATCAAAGAGCTGGGCAGCCAGATCCTGAAAGAACACCCCGTGGA |

TABLE 18-continued

Sequence listing.

| SEQ | Description | Sequence |
|---|---|---|
| | | AAACACCCAGCTGCAGAACGAGAAGCTGTACCTGTACTACCTGCAGAATGGGCG |
| | | GGATATGTACGTGGACCAGGAACTGGACATCAACCGGCTGTCCGACTACGATGT |
| | | GGACGCCATCGTGCCTCAGAGCTTTCTGAAGGACGACTCCATCGACAACAAGGT |
| | | GCTGACCAGAAGCGACAAGAACCGGGGCAAGAGCGACAACGTGCCCTCCGAAGA |
| | | GGTCGTGAAGAAGATGAAGAACTACTGGCGGCAGCTGCTGAACGCCAAGCTGAT |
| | | TACCCAGAGAAAGTTCGACAATCTGACCAAGGCCGAGAGAGGCGGCCTGAGCGA |
| | | ACTGGATAAGGCCGGCTTCATCAAGAGACAGCTGGTGGAAACCCGGCAGATCAC |
| | | AAAGCACGTGGCACAGATCCTGGACTCCCGGATGAACACTAAGTACGACGAGAA |
| | | TGACAAGCTGATCCGGGAAGTGAAAGTGATCACCCTGAAGTCCAAGCTGGTGTC |
| | | CGATTTCCGGAAGGATTTCCAGTTTTACAAAGTGCGCGAGATCAACAACTACCA |
| | | CCACGCCCACGACGCCTACCTGAACGCCGTCGTGGGAACCGCCCTGATCAAAAA |
| | | GTACCCTAAGCTGGAAAGCGAGTTCGTGTACGGCGACTACAAGGTGTACGACGT |
| | | GCGGAAGATGATCGCCAAGAGCGAGCAGGAAATCGGCAAGGCTACCGCCAAGTA |
| | | CTTCTTCTACAGCAACATCATGAACTTTTTCAAGACCGAGATTACCCTGGCCAA |
| | | CGGCGAGATCCGGAAGCGGCCTCTGATCGAGACAAACGGCGAAACCGGGGAGAT |
| | | CGTGTGGGATAAGGGCCGGGATTTTGCCACCGTGCGGAAAGTGCTGAGCATGCC |
| | | CCAAGTGAATATCGTGAAAAAGACCGAGGTGCAGACAGGCGGCTTCAGCAAGGA |
| | | GTCTATCCTGCCCAAGAGGAACAGCGATAAGCTGATCGCCAGAAAGAAGGACTG |
| | | GGACCCTAAGAAGTACGGCGGCTTCGACAGCCCCACCGTGGCCTATTCTGTGCT |
| | | GGTGGTGGCCAAAGTGGAAAAGGGCAAGTCCAAGAAACTGAAGAGTGTGAAAGA |
| | | GCTGCTGGGGATCACCATCATGGAAAGAAGCAGCTTCGAGAAGAATCCCATCGA |
| | | CTTTCTGGAAGCCAAGGGCTACAAAGAAGTGAAAAAGGACCTGATCATCAAGCT |
| | | GCCTAAGTACTCCCTGTTCGAGCTGGAAAACGGCCGGAAGAGAATGCTGGCCTC |
| | | TGCCGGCGAACTGCAGAAGGGAAACGAACTGGCCCTGCCCTCCAAATATGTGAA |
| | | CTTCCTGTACCTGGCCAGCCACTATGAGAAGCTGAAGGGCTCCCCCGAGGATAA |
| | | TGAGCAGAAACAGCTGTTTGTGGAACAGCACAAGCACTACCTGGACGAGATCAT |
| | | CGAGCAGATCAGCGAGTTCTCCAAGAGAGTGATCCTGGCCGACGCTAATCTGGA |
| | | CAAAGTGCTGTCCGCCTACAACAAGCACCGGGATAAGCCCATCAGAGAGCAGGC |
| | | CGAGAATATCATCCACCTGTTTACCCTGACCAATCTGGGAGCCCCTGCCGCCTT |
| | | CAAGTACTTTGACACCACCATCGACCGGAAGAGGTACACCAGCACCAAAGAGGT |
| | | GCTGGACGCCACCCTGATCCACCAGAGCATCACCGGCCTGTACGAGACACGGAT |
| | | CGACCTGTCTCAGCTGGGAGGCGACAGCCCCAAGAAGAAGAGAAAGGTGGGAGT |
| | | CGACGGATCCAGCGGCTCCGAGACCCCAGGCACATCTGAGAGCGCCACCCCTGA |
| | | GTCCACCGGTATGAACAATTCACAGGGGAGAGTGACATTCGAAGACGTGACCGT |
| | | GAACTTCACCCAGGGAGAATGGCAGCGCTTGAACCCAGAACAAAGGAACCTCTA |
| | | TCGGGACGTGATGCTGGAAAACTACTCAAATTTGGTGAGCGTTGGGCAGGGTGA |
| | | GACCACTAAGCCTGACGTGATCCTGAGATTGGAACAGGGCAAGGAGCCTTGGCT |
| | | CGAGGAAGAGGAAGTTCCTGGGCTCAGGGAGGGCCGAGAAAAACGGTGATATAGG |
| | | AGGCCAGATATGGAAGCCTAAGGACGTCAAGGAGAGCCTGAGCGCTGCTAAACG |
| | | TCCGGCAGCAACCAAAAAAGCAGGTCAGGCCAAGAAAAATGAGGATCCTGAGT |
| | | CTAGAAAGAGCCTTCTGAGCCCAGCGACTTCTGAAGGGCCCCTTGCAAAGTAAT |
| | | AGGGCTTCTGCCTAAGCCTCTCCCTCCAGCCAATAGGCAGCTTTCTTAACTATC |
| | | CTAACAAGCCTTGGACCAAATGGAAATAAAGCTTTTTGATGCAGTGTTAATTAA |
| | | AAAAAAAAAAAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAAA |
| | | AAAAAAAAAAGAAGAGCGAATTCACTGGCCGTCGTTTTACAACGTCGTGACTG |
| | | GGAAAACCCTGGCGTTACCCAACTTAATCGCCTTGCAGCACATCCCCCTTTCGC |
| | | CAGCTGGCGTAATAGCGAAGAGGCCCGCACCGATCGCCCTTCCCAACAGTTGCG |
| | | CAGCCTGAATGGCGAATGGCGCCTGATGCGGTATTTTCTCCTTACGCATCTGTG |
| | | CGGTATTTCACACCGCATATGGTGCACTCTCAGTACAATCTGCTCTGATGCCGC |
| | | ATAGTTAAGCCAGCCCCGACACCCGCCAACACCCGCTGACGCGCCCTGACGGGC |
| | | TTGTCTGCTCCCGGCATCCGCTTACAGACAAGCTGTGACCGTCTCCGGGAGCTG |
| | | CATGTGTCAGAGGTTTTCACCGTCATCACCGAAACGCGCGATGCAGCTCTGGCC |
| | | CGTGTCTCAAAATCTCTGATGTTACATTGCACAAGATAAAAATATATCATCATG |
| | | AACAATAAAACTGTCTGCTTACATAAACAGTAATACAAGGGGTGTTATGAGCCA |
| | | TATTCAACGGGAAACGTCGAGGCCGCGATTAAATTCCAACATGGATGCTGATTT |
| | | ATATGGGTATAAATGGGCTCGCGATAATGTCGGGCAATCAGGTGCGACAATCTA |
| | | TCGCTTGTATGGGAAGCCCGATGCGCCAGAGTTGTTTCTGAAACATGGCAAAGG |
| | | TAGCGTTGCCAATGATGTTACAGATGAGATGGTCAGACTAAACTGGCTGACGGA |
| | | ATTTATGCCTCTTCCGACCATCAAGCATTTTATCCGTACTCCTGATGATGCATG |
| | | GTTACTCACCACTGCGATCCCCGGAAAAACAGCATTCCAGGTATTAGAAGAATA |
| | | TCCTGATTCAGGTGAAAATATTGTTGATGCGCTGGCAGTGTTCCTGCGCCGGTT |
| | | GCATTCGATTCCTGTTTGTAATTGTCCTTTTAACAGCGATCGCGTATTTCGTCT |
| | | CGCTCAGGCGCAATCACGAATGAATAACGGTTTGGTTGATGCGAGTGATTTTGA |
| | | TGACGAGCGTAATGGCTGGCCTGTTGAACAAGTCTGGAAAGAAATGCATAAACT |
| | | TTTGCCATTCTCACCGGATTCAGTCGTCACTCATGGTGATTTCTCACTTGATAA |
| | | CCTTATTTTTGACGAGGGGAAATTAATAGGTTGTATTGATGTTGGACGAGTCGG |
| | | AATCGCAGACCGATACCAGGATCTTGCCATCCTATGGAACTGCCTCGGTGAGTT |
| | | TTCTCCTTCATTACAGAAACGGCTTTTTCAAAAATATGGTATTGATAATCCTGA |
| | | TATGAATAAATTGCAGTTTCATTTGATGCTCGATGAGTTTTTCTAATCAGAATT |
| | | GGTTAATTGGTTGTAACATTATTCAGATTGGGCTTGATTTAAAACTTCATTTTT |
| | | AATTTAAAAGGATCTAGGTGAAGATCCTTTTTGATAATCTCATGACCAAAATCC |
| | | CTTAACGTGAGTTTTCGTTCCACTGAGCGTCAGACCCCGTAGAAAAGATCAAAG |
| | | GATCTTCTTGAGATCCTTTTTTTCTGCGCGTAATCTGCTGCTTGCAAACAAAAA |
| | | AACCACCGCTACCAGCGGTGGTTTGTTTGCCGGATCAAGAGCTACCAACTCTTT |
| | | TTCCGAAGGTAACTGGCTTCAGCAGAGCGCAGATACCAAATACTGTTCTTCTAG |

TABLE 18-continued

Sequence listing.

| SEQ | Description | Sequence |
|---|---|---|
|  |  | TGTAGCCGTAGTTAGGCCACCACTTCAAGAACTCTGTAGCACCGCCTACATACC<br>TCGCTCTGCTAATCCTGTTACCAGTGGCTGCTGCCAGTGGCGATAAGTCGTGTC<br>TTACCGGGTTGGACTCAAGACGATAGTTACCGGATAAGGCGCAGCGGTCGGGCT<br>GAACGGGGGGTTCGTGCACACAGCCCAGCTTGGAGCGAACGACCTACACCGAAC<br>TGAGATACCTACAGCGTGAGCTATGAGAAAGCGCCACGCTTCCCGAAGGGAGAA<br>AGGCGGACAGGTATCCGGTAAGCGGCAGGGTCGGAACAGGAGAGCGCACGAGGG<br>AGCTTCCAGGGGAAACGCCTGGTATCTTTATAGTCCTGTCGGGTTTCGCCACC<br>TCTGACTTGAGCGTCGATTTTTGTGATGCTCGTCAGGGGGGCGGAGCCTATGA<br>AAAACGCCAGCAACGCGGCCTTTTTACGGTTCCTGGCCTTTTGCTGGCCTTTTG<br>CTCACATGTTCTTTCCTGCGTTATCCCCTGATTCTGTGGATAACCGTATTACCG<br>CCTTTGAGTGAGCTGATACCGCTCGCCGCAGCCGAACGACCGAGCGCAGCGAGT<br>CAGTGAGCGAGGAAGCGGCCCAATACGCAAACCGCCTCTCCCCGCGCGTTGGCC<br>GATTCATTAATGCAGCTGGCACGACAGGTTTCCCGACTGGAAAGCGGGCAGTGA<br>GCGCAACGCAATTAATGTGAGTTAGCTCACTCATTAGGCACCCCAGGCTTTACA<br>CTTTATGCTTCCGGCTCGTATGTTGTGTGGAATTGTGAGCGGATAACAATTTCA<br>CACAGGAAACAGCTATGACCATGATTACGCCAAGCTTTAATACGACTCACTATA |
| 1254 | CRISPR-Off<br>variant 2 amino<br>acid sequence | MKRPAATKKAGQAKKKYNHDQEFDPPKVYPPVPAEKRKPIRVLSLEDGIATGLL<br>VLKDLGIQVDRYIASEVCEDSITVGMVRHQGKIMYVGDVRSVTQKHIQEWGPFD<br>LVIGGSPCNDLSIVNPARKGLYEGTGRLFFEFYRLLHDARPKEGDDRPFFWLFE<br>NVVAMGVSDKRDISRFLESNPVMIDAKEVSAAHRARYFWGNLPGMNRPLASTVN<br>DKLELQECLEHGRIAKFSKVRTITTRSNSIKQGKDQHFPVFMNEKEDILWCTEM<br>ERVFGFPVHYTDVSNMSRLARQRLLGRSWSVPVIRHLFAPLKEYFACVSSGNSN<br>ANSRGPSFSSGLVPLSLRGSHSPMEIYKTVSAWKRQPVRVLSLFGNIDKELKSL<br>GFLEIGSDSEGGTLKYVEDVTNVVRRDVEKWGPFDLVYGSTNPLGNSCDRCPGW<br>YMFQFHRILQYARPRQDSQKPFFWIFMDNLLLTEDDQVTTVRFLQTEAVTLQDV<br>RGRVLQNAVRVWSNIPGLKSKHSVLTPKEEQSLQAQVRTRSKLPTQVNPLVKTC<br>LLPLREYFKCFSQNSLPLGGPSSGAPPPSGGSPAGSPTSTEEGTSESATPESGP<br>GTSTEPSEGSAPGSPAGSPTSTEEGTSTEPSEGSAPGTSTEPSELEDKKYSIGL<br>AIGTNSVGWAVITDEYKVPSKKFKVLGNTDRHSIKKNLIGALLEDSGETAEATR<br>LKRTARRRYTRRKNRICYLQEIFSNEMAKVDDSFFHRLEESFLVEEDKKHERHP<br>IFGNIVDEVAYHEKYPTIYHLRKKLVDSTDKADLRLIYLALAHMIKERGHFLIE<br>GDLNPDNSDVDKLFIQLVQTYNQLFEENPINASGVDAKAILSARLSKSRRLENL<br>IAQLPGEKKNGLFGNLIALSLGLTPNEKSNFDLAEDAKLQLSKDTYDDDLDNLL<br>AQIGDQYADLFLAAKNLSDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPELKDNREKIE<br>KILTFRIPYYVGPLARGNSRFAWMTRKSEETITPWNFEEVVDKGASAQSFIERM<br>TNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRENASLGTYHDLLKIIKD<br>KDFLDNEENEDILEDIVLTLTLFEDREMIEERLKTYAHLEDDKVMKQLKRRRYT<br>GWGRLSRKLINGIRDKQSGKTILDFLKSDGFANRNFMQLIHDDSLTFKEDIQKA<br>QVSGQGDSLHEHIANLAGSPAIKKGILQTVKVVDELVKVMGRHKPENIVIEMAR<br>ENQTTQKGQKNSRERMKRIEEGIKELGSQILKEHPVENTQLQNEKLYLYYLQNG<br>RDMYVDQELDINRLSDYDVDAIVPQSFLKDDSIDNKVLTRSDKNRGKSDNVPSE<br>EVVKKMKNYWRQLLNAKLITQRKEDNLTKAERGGLSELDKAGFIKRQLVETRQI<br>TKHVAQILDSRMNTKYDENDKLIREVKVITLKSKLVSDFRKDFQFYKVREINNY<br>HHAHDAYLNAVVGTALIKKYPKLESEFVYGDYKVYDVRKMIAKSEQEIGKATAK<br>YFFYSNIMNFFKTEITLANGEIRKRPLIETNGETGEIVWDKGRDFATVRKVLSM<br>PQVNIVKKTEVQTGGFSKESILPKRNSDKLIARKKDWDPKKYGGFDSPTVAYSV<br>LVVAKVEKGKSKKLKSVKELLGITIMERSSFEKNPIDFLEAKGYKEVKKDLIIK<br>LPKYSLFELENGRKRMLASAGELQKGNELALPSKYVNFLYLASHYEKLKGSPED<br>NEQKQLFVEQHKHYLDEIIEQISEFSKRVILADANLDKVLSAYNKHRDKPIREQ<br>AENIIHLFTLTNLGAPAAFKYFDTTIDRKRYTSTKEVLDATLIHQSITGLYETR<br>IDLSQLGGDSPKKKRKVGVDSSGSETPGTSESATPESTGMNNSQGRVTFEDVT<br>VNFTQGEWQRLNPEQRNLYRDVMLENYSNLVSVGQGETTKPDVILRLEQGKEPW<br>LEEEEVLGSGRAEKNGDIGGQIWKPKDVKESLSAAKRPAATKKAGQAKKK |
| 1255 | CRISPR-Off<br>variant 3 plasmid<br>sequence | AGAAACTAGCGTAAATTCAAATATAGGTCAGGCTTCAACGTCAACAAATATGAT<br>GAAGAGACCTGCTGCCACCAAGAAGGCCGGCCAGGCCAAGAAAAGTACAATCA<br>CGATCAGGAGTTCGACCCCCCTAAGGTGTACCCACCAGTGCCTGCAGAGAAGAG<br>GAAGCCAATCCGGGTGCTGAGCCTGTTTGATGGCATCGCCACCGGCCTGCTGGT<br>GCTGAAGGATCTGGGCATCCAGGTGGACCGGTACATCGCCTCCGAGGTGTGCGA<br>GGATTCTATCACCGTGGGCATGGTGCGCCACCAGGGCAAGATCATGTATGTGGG<br>CGACGTGCGGTCCGTGACACAGAAGCACATCCAGGAGTGGGGCCCATTCGATCT<br>GGTGATCGGCGGCAGCCCCTGTAATGACCTGTCCATCGTGAACCCTGCAAGGAA<br>GGGACTGTACGAGGGAACCGGCCGGCTGTTCTTTGAGTTTTATAGACTGCTGCA<br>CGACGCCAGGCCTAAGGAGGGCGACGATAGACCATTCTTTTGGCTGTTCGAGAA<br>TGTGGTGGCTATGGGCGTGAGCGATAAGAGGGACATCTCCAGGTTTCTGGAGTC<br>TAACCCCGTGATGATCGATGCAAAGGAGGTGTCCGCCGCACACAGAGCCAGGTA<br>TTTCTGGGGCAATCTGCCAGGAATGAACAGGCCACTGGCAAGCACCGTGAATGA<br>CAAGCTGGAGCTGCAGGAGTGCCTGGAGCACGGAAGGATCGCCAAGTTTTCCAA<br>GGTGCGCACAATCACCACACGGAGCAATTCCATCAAGCAGGGCAAGGATCAGCA<br>CTTCCCCGTGTTCATGAACGAGAAGGAGGACATCCTGTGGTGTACCGAGATGGA<br>GAGAGTGTTCGGCTTTCCAGTGCACTACACAGACGTGTCTAACATGAGCAGGCT<br>GGCAAGGCAGCGGCTGCTGGGCAGATCTTGGAGCGTGCCCGTGATCAGGCACCT |

TABLE 18-continued

Sequence listing.

| SEQ | Description | Sequence |
|---|---|---|
| | | GTTCGCCCCTCTGAAGGAGTATTTTGCCTGCGTGAGCAGCGGCAACTCCAATGC
CAACAGCCGGGGCCCCTCTTTCAGCTCCGGATTGGTGCCTCTGAGCCTGAGGGG
CTCCCACAGTCCCCTTGAGATGTATAAAACTGTGCCTGTGTGGAAGAGAGAGCC
AGTGCGGGTGCTGTCCCTTTTTGGTGACATCAAGAAAGAGCTGACGACTTTGGG
CTTTCTGGAAAACGGCTCTGACCCGGGCCGACTGAAACATTTGGACGATGTCAC
CAATACGGTGAGGAGGGACGTGGAAGAATGGGGCCCGTTCGACCTCGTGTACGG
CTCCACGCCGCCCCTCGGCCACGCCTGTGACCATCCTCCCGGGTGGTACCTGTT
CCAGTTCCACCGTGTGCTTCAGTACGCGAGGCCCAGGCCGGGCAGCCCGCAGGC
CTTCTTCTGGATGTTTGTGGACAACCTGGTGCTGACCGAGGATGACCGGGCTGT
AGCCACTCGCTTCCTGGAGACTGACCCGGTGACCATCCAGGACGTCTGTGGCAG
AGCTGTCCGGAACGCCGTGCACGTGTGGAGCAACATCCCGGCCGTGAAAAGCAG
GCACTCGGCCCTGTTTTCCCAGGAGGAATCATTCCTGCGGGCTCAGGACAGGCA
GAGAGCAAAGCCCCCCGCCCGGGGGCCAGCCAAGCTGGTGAAGAATTGTTTTCT
CCCCCTGAGAGAATATTTCAAGTATTTTTCAACAGAATTCACTTCCTCTTTGGG
AGGACCCTCCTCTGGCGCCCCACCACCTAGCGGCGGCTCCCCTGCCGGCTCTCC
AACCAGCACAGAGGAGGGCACCAGCGAGTCCGCCACACCAGAGTCTGGACCTGG
CACCAGCACAGAGCCATCCGAGGGCTCTGCCCCAGGCTCTCCTGCAGGCAGCCC
TACCTCCACCGAAGAGGGCACCAGCACAGAGCCTTCTGAGGGCAGCGCCCCAGG
CACCTCTACAGAGCCAAGCGAGCTCGAGGACAAGAAGTACAGCATCGGCCTGGC
CATCGGCACCAACTCTGTGGGCTGGGCCGTGATCACCGACGAGTACAAGGTGCC
CAGCAAGAAATTCAAGGTGCTGGGCAACACCGACCGGCACAGCATCAAGAAGAA
CCTGATCGGAGCCCTGCTGTTCGACAGCGGCGAAACAGCCGAGGCCACCCGGCT
GAAGAGAACCGCCAGAAGAAGATACACCAGACGGAAGAACCGGATCTGCTATCT
GCAAGAGATCTTCAGCAACGAGATGGCCAAGGTGGACGACAGCTTCTTCCACAG
ACTGGAAGAGTCCTTCCTGGTGGAAGAGGATAAGAAGCACGAGCGGCACCCCAT
CTTCGGCAACATCGTGGACGAGGTGGCCTACCACGAGAAGTACCCCACCATCTA
CCACCTGAGAAAGAAACTGGTGGACAGCACCGACAAGGCCGACCTGCGGCTGAT
CTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCA
GACCTACAACCAGCTGTTCGAGGAAAACCCCATCAACGCCAGCGGCGTGGACGC
CAAGGCCATCCTGTCTGCCAGACTGAGCAAGAGCAGACGGCTGGAAAATCTGAT
CGCCCAGCTGCCCGGCGAGAAGAAGAATGGCCTGTTCGGCAACCTGATTGCCCT
GAGCCTGGGCCTGACCCCCAACTTCAAGAGCAACTTCGACCTGGCCGAGGATGC
CAAACTGCAGCTGAGCAAGGACACCTACGACGACGACCTGGACAACCTGCTGGC
CCAGATCGGCGACCAGTACGCCGACCTGTTTCTGGCCGCCAAGAACCTGTCCGA
CGCCATCCTGCTGAGCGACATCCTGAGAGTGAACACCGAGATCACCAAGGCCCC
CCTGAGCGCCTCTATGATCAAGAGATACGACGAGCACCACCAGGACCTGACCCT
GCTGAAAGCTCTCGTGCGGCAGCAGCTGCCTGAGAAGTACAAAGAGATTTTCTT
CGACCAGAGCAAGAACGGCTACGCCGGCTACATTGACGGCGGAGCCAGCCAGGA
AGAGTTCTACAAGTTCATCAAGCCCATCCTGGAAAAGATGGACGGCACCGAGGA
ACTGCTCGTGAAGCTGAACAGAGAGGACCTGCTGCGGAAGCAGCGGACCTTCGA
CAACGGCAGCATCCCCCACCAGATCCACCTGGGAGAGCTGCACGCCATTCTGCG
GCGGCAGGAAGATTTTTACCCATTCCTGAAGGACAACCGGGAAAAGATCGAGAA
GATCCTGACCTTCCGCATCCCTACTACGTGGGCCCTCTGGCCAGGGGAAACAG
CAGATTCGCCTGGATGACCAGAAAGAGCGAGGAAACCATCACCCCCTGGAACTT
CGAGGAAGTGGTGGACAAGGGCGCTTCCGCCCAGAGCTTCATCGAGCGGATGAC
CAACTTCGATAAGAACCTGCCCAACGAGAAGGTGCTGCCCAAGCACAGCCTGCT
GTACGAGTACTTCACCGTGTATAACGAGCTGACCAAAGTGAAATACGTGACCGA
GGGAATGAGAAAGCCCGCCTTCCTGAGCGGCGAGCAGAAAAAGGCCATCGTGGA
CCTGCTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAGATCG
GTTCAACGCCTCCCTGGGCACATACCACGATCTGCTGAAAATTATCAAGGACAA
GGACTTCCTGGACAATGAGGAAAACGAGGACATTCTGGAAGATATCGTGCTGAC
CCTGACACTGTTTGAGGACAGAGAGATGATCGAGGAACGGCTGAAAACCTATGC
CCACCTGTTCGACGACAAAGTGATGAAGCAGCTGAAGCGGCGGAGATACACCGG
CTGGGGCAGGCTGAGCCGGAAGCTGATCAACGGCATCCGGGACAAGCAGTCCGG
CAAGACAATCCTGGATTTCCTGAAGTCCGACGGCTTCGCCAACAGAAACTTCAT
GCAGCTGATCCACGACGACAGCCTGACCTTTAAAGAGGACATCCAGAAAGCCCA
GGTGTCCGGCCAGGGCGATAGCCTGCACGAGCACATTGCCAATCTGGCCGGCAG
CCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGA
GAACCAGACCACCCAGAAGGGACAGAAGAACAGCCGCGAGAGAATGAAGCGGAT
CGAAGAGGGCATCAAAGAGCTGGGCAGCCAGATCCTGAAAGAACACCCCGTGGA
AAACACCCAGCTGCAGAACGAGAAGCTGTACCTGTACTACCTGCAGAATGGGCG
GGATATGTACGTGGACCAGGAACTGGACATCAACCGGCTGTCCGACTACGATGT
GGACGCCATCGTGCCTCAGAGCTTTCTGAAGGACGACTCCATCGACAACAAGGT
GCTGACCAGAAGCGACAAGAACCGGGGCAAGAGCGACAACGTGCCCTCCGAAGA
GGTCGTGAAGAAGATGAAGAACTACTGGCGGCAGCTGCTGAACGCCAAGCTGAT
TACCCAGAGAAAGTTCGACAATCTGACCAAGGCCGAGAGAGGCGGCCTGAGCGA
ACTGGATAAGGCCGGCTTCATCAAGAGACAGCTGGTGGAAACCCGGCAGATCAC
AAAGCACGTGGCACAGATCCTGGACTCCCGGATGAACACTAAGTACGACGAGAA
TGACAAGCTGATCCGGGAAGTGAAAGTGATCACCCTGAAGTCCAAGCTGGTGTC
CGATTTCCGGAAGGATTTCCAGTTTTACAAAGTGCGCGAGATCAACAACTACCA
CCACGCCCACGACGCCTACCTGAACGCCGTCGTGGGAACCGCCCTGATCAAAAA
GTACCCTAAGCTGGAAAGCGAGTTCGTGTACGGCGACTACAAGGTGTACGACGT
GCGGAAGATGATCGCCAAGAGCGAGCAGGAAATCGGCAAGGCTACCGCCAAGTA |

TABLE 18-continued

Sequence listing.

| SEQ | Description | Sequence |
|---|---|---|
| | | CTTCTTCTACAGCAACATCATGAACTTTTTCAAGACCGAGATTACCCTGGCCAA |
| | | CGGCGAGATCCGGAAGCGGCCTCTGATCGAGACAAACGGCGAAACCGGGGAGAT |
| | | CGTGTGGGATAAGGGCCGGGATTTTGCCACCGTGCGGAAAGTGCTGAGCATGCC |
| | | CCAAGTGAATATCGTGAAAAAGACCGAGGTGCAGACAGGCGGCTTCAGCAAAGA |
| | | GTCTATCCTGCCCAAGAGGAACAGCGATAAGCTGATCGCCAGAAAGAAGGACTG |
| | | GGACCCTAAGAAGTACGGCGGCTTCGACAGCCCCACCGTGGCCTATTCTGTGCT |
| | | GGTGGTGGCCAAAGTGGAAAAGGGCAAGTCCAAGAAACTGAAGAGTGTGAAAGA |
| | | GCTGCTGGGGATCACCATCATGGAAAGAAGCAGCTTCGAGAAGAATCCCATCGA |
| | | CTTTCTGGAAGCCAAGGGCTACAAAGAAGTGAAAAAGGACCTGATCATCAAGCT |
| | | GCCTAAGTACTCCCTGTTCGAGCTGGAAAACGGCCGGAAGAGAATGCTGGCCTC |
| | | TGCCGGCGAACTGCAGAAGGGAAACGAACTGGCCCTGCCCTCCAAATATGTGAA |
| | | CTTCCTGTACCTGGCCAGCCACTATGAGAAGCTGAAGGGCTCCCCCGAGGATAA |
| | | TGAGCAGAAACAGCTGTTTGTGGAACAGCACAAGCACTACCTGGACGAGATCAT |
| | | CGAGCAGATCAGCGAGTTCTCCAAGAGAGTGATCCTGGCCGACGCTAATCTGGA |
| | | CAAAGTGCTGTCCGCCTACAACAAGCACGGGATAAGCCCATCAGAGAGCAGGC |
| | | CGAGAATATCATCCACCTGTTTACCCTGACCAATCTGGGAGCCCCTGCCGCCTT |
| | | CAAGTACTTTGACACCACCATCGACCGGAAGAGGTACACCAGCACCAAAGAGGT |
| | | GCTGGACGCCACCCTGATCCACCAGAGCATCACCGGCCTGTACGAGACACGGAT |
| | | CGACCTGTCTCAGCTGGGAGGCGACAGCCCCAAGAAGAAGAGAAAGGTGGGAGT |
| | | CGACGGATCCAGCGGCTCCGAGACCCCAGGCACATCTGAGAGCGCCACCCCTGA |
| | | GTCCACCGGTATGAACAATTCACAGGGGAGAGTGACATTCGAAGACGTGACCGT |
| | | GAACTTCACCCAGGGAGAATGGCAGCGCTTGAACCCAGAACAAAGGAACCTCTA |
| | | TCGGGACGTGATGCTGGAAAACTACTCAAATTTGGTGAGCGTTGGGCAGGGTGA |
| | | GACCACTAAGCCTGACGTGATCCTGAGATTGGAACAGGGCAAGGAGCCTTGGCT |
| | | CGAGGAAGAGGAAGTCCTGGGCTCAGGGAGGGCCGAGAAAAACGGTGATATAGG |
| | | AGGCCAGATATGGAAGCCTAAGGACGTCAAGGAGAGCCTGAGCGCTAAACGTCC |
| | | GGCAGCAACCAAAAAAGCAGGTCAGGCCAAGAAAAAATGAGGATCCTGAGTCTA |
| | | GAAAAGATATATATAGGATTGAAGATCTCTCAGTTAAGTCTACAAAAAAAAAAA |
| | | AAAAAAAAAAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAA |
| | | AAGAAGAGCGAATTCACTGGCCGTCGTTTTACAACGTCGTGACTGGGAAAACCC |
| | | TGGCGTTACCCAACTTAATCGCCTTGCAGCACATCCCCCTTTCGCCAGCTGGCG |
| | | TAATAGCGAAGAGGCCCGCACCGATCGCCCTTCCCAACAGTTGCGCAGCCTGAA |
| | | TGGCGAATGGCGCCTGATGCGGTATTTTCTCCTTACGCATCTGTGCGGTATTTC |
| | | ACACCGCATATGGTGCACTCTCAGTACAATCTGCTCTGATGCCGCATAGTTAAG |
| | | CCAGCCCCGACACCCGCCAACACCCGCTGACGCGCCCTGACGGGCTTGTCTGCT |
| | | CCCGGCATCCGCTTACAGACAAGCTGTGACCGTCTCCGGGAGCTGCATGTGTCA |
| | | GAGGTTTTCACCGTCATCACCGAAACGCGCGATGCAGCTCTGGCCCGTGTCTCA |
| | | AAATCTCTGATGTTACATTGCACAAGATAAAAATATATCATCATGAACAATAAA |
| | | ACTGTCTGCTTACATAAACAGTAATACAAGGGGTGTTATGAGCCATATTCAACG |
| | | GGAAACGTCGAGGCCGCGATTAAATTCCAACATGGATGCTGATTTATATGGGTA |
| | | TAAATGGGCTCGCGATAATGTCGGGCAATCAGGTGCGACAATCTATCGCTTGTA |
| | | TGGGAAGCCCGATGCGCCAGAGTTGTTTCTGAAACATGGCAAAGGTAGCGTTGC |
| | | CAATGATGTTACAGATGAGATGGTCAGACTAAACTGGCTGACGGAATTTATGCC |
| | | TCTTCCGACCATCAAGCATTTTATCCGTACTCCTGATGATGCATGGTTACTCAC |
| | | CACTGCGATCCCCGGAAAAACAGCATTCCAGGTATTAGAAGAATATCCTGATTC |
| | | AGGTGAAAATATTGTTGATGCGCTGGCAGTGTTCCTGCGCCGGTTGCATTCGAT |
| | | TCCTGTTTGTAATTGTCCTTTTAACAGCGATCGCGTATTTCGTCTCGCTCAGGC |
| | | GCAATCACGAATGAATAACGGTTTGGTTGATGCGAGTGATTTTGATGACGAGCG |
| | | TAATGGCTGGCCTGTTGAACAAGTCTGGAAAGAAATGCATAAACTTTTGCCATT |
| | | CTCACCGGATTCAGTCGTCACTCATGGTGATTTCTCACTTGATAACCTTATTTT |
| | | TGACGAGGGGAAATTAATAGGTTGTATTGATGTTGGACGAGTCGGAATCGCAGA |
| | | CCGATACCAGGATCTTGCCATCCTATGGAACTGCCTCGGTGAGTTTTCTCCTTC |
| | | ATTACAGAAACGGCTTTTTCAAAAATATGGTATTGATAATCCTGATATGAATAA |
| | | ATTGCAGTTTCATTTGATGCTCGATGAGTTTTTCTAATCAGAATTGGTTAATTG |
| | | GTTGTAACATTATTCAGATTGGGCTTGATTTAAAACTTCATTTTTAATTTAAAA |
| | | GGATCTAGGTGAAGATCCTTTTTGATAATCTCATGACCAAAATCCCTTAACGTG |
| | | AGTTTTCGTTCCACTGAGCGTCAGACCCCGTAGAAAAGATCAAAGGATCTTCTT |
| | | GAGATCCTTTTTTTCTGCGCGTAATCTGCTGCTTGCAAACAAAAAAACCACCGC |
| | | TACCAGCGGTGGTTTGTTTGCCGGATCAAGAGCTACCAACTCTTTTTCCGAAGG |
| | | TAACTGGCTTCAGCAGAGCGCAGATACCAAATACTGTTCTTCTAGTGTAGCCGT |
| | | AGTTAGGCCACCACTTCAAGAACTCTGTAGCACCGCCTACATACCTCGCTCTGC |
| | | TAATCCTGTTACCAGTGGCTGCTGCCAGTGGCGATAAGTCGTGTCTTACCGGGT |
| | | TGGACTCAAGACGATAGTTACCGGATAAGGCGCAGCGGTCGGGCTGAACGGGGG |
| | | GTTCGTGCACACAGCCCAGCTTGGAGCGAACGACCTACACCGAACTGAGATACC |
| | | TACAGCGTGAGCTATGAGAAAGCGCCACGCTTCCCGAAGGGAGAAAGGCGGACA |
| | | GGTATCCGGTAAGCGGCAGGGTCGGAACAGGAGAGCGCACGAGGGAGCTTCCAG |
| | | GGGGAAACGCCTGGTATCTTTATAGTCCTGTCGGGTTTCGCCACCTCTGACTTG |
| | | AGCGTCGATTTTTGTGATGCTCGTCAGGGGGCGGAGCCTATGGAAAAACGCCA |
| | | GCAACGCGGCCTTTTTACGGTTCCTGGCCTTTTGCTGGCCTTTTGCTCACATGT |
| | | TCTTTCCTGCGTTATCCCCTGATTCTGTGGATAACCGTATTACCGCCTTTGAGT |
| | | GAGCTGATACCGCTCGCCGCAGCCGAACGACCGAGCGCAGCGAGTCAGTGAGCG |
| | | AGGAAGCGGCCAATACGCAAACCGCCTCTCCCCGCGCGTTGGCCGATTCATTA |
| | | ATGCAGCTGGCACGACAGGTTTCCCGACTGGAAAGCGGGCAGTGAGCGCAACGC |
| | | AATTAATGTGAGTTAGCTCACTCATTAGGCACCCCAGGCTTTACACTTTATGCT |
| | | TCCGGCTCGTATGTTGTGTGGAATTGTGAGCGGATAACAATTTCACACAGGAAA |

TABLE 18-continued

Sequence listing.

| SEQ | Description | Sequence |
|---|---|---|
| | | CAGCTATGACCATGATTACGCCAAGCTTTAATACGACTCACTATA |
| 1256 | CRISPR-Off variant 3 amino acid sequence | MKRPAATKKAGQAKKKYNHDQEFDPPKVYPPVPAEKRKPIRVLSLEDGIATGLL VLKDLGIQVDRYIASEVCEDSITVGMVRHQGKIMYVGDVRSVTQKHIQEWGPED LVIGGSPCNDLSIVNPARKGLYEGTGRLFFEFYRLLHDARPKEGDDRPFFWLFE NVVAMGVSDKRDISRFLESNPVMIDAKEVSAAHRARYFWGNLPGMNRPLASTVN DKLELQECLEHGRIAKFSKVRTITTRSNSIKQGKDQHFPVEMNEKEDILWCTEM ERVFGFPVHYTDVSNMSRLARQRLLGRSWSVPVIRHLFAPLKEYFACVSSGNSN ANSRGPSFSSGLVPLSLRGSHSPLEMYKTVPVWKREPVRVLSLFGDIKKELTTL GFLENGSDPGRLKHLDDVTNTVRRDVEEWGPFDLVYGSTPPLGHACDHPPGWYL FQFHRVLQYARPRPGSPQAFFWMFVDNLVLTEDDRAVATRFLETDPVTIQDVCG RAVRNAVHVWSNIPAVKSRHSALESQEESFLRAQDRQRAKPPARGPAKLVKNCF LPLREYFKYFSTEFTSSLGGPSSGAPPPSGGSPAGSPTSTEEGTSESATPESGP GTSTEPSEGSAPGSPAGSPTSTEEGTSTEPSEGSAPGTSTEPSELEDKKYSIGL AIGTNSVGWAVITDEYKVPSKKFKVLGNTDRHSIKKNLIGALLEDSGETAEATR LKRTARRRYTRRKNRICYLQEIFSNEMAKVDDSFFHRLEESELVEEDKKHERHP IFGNIVDEVAYHEKYPTIYHLRKKLVDSTDKADLRLIYLALAHMIKERGHFLIE GDLNPDNSDVDKLFIQLVQTYNQLFEENPINASGVDAKAILSARLSKSRRLENL IAQLPGEKKNGLFGNLIALSLGLTPNEKSNEDLAEDAKLQLSKDTYDDDLDNLL AQIGDQYADLFLAAKNLSDAILLSDILRVNTEITKAPLSASMIKRYDEHHQDLT LLKALVRQQLPEKYKEIFFDQSKNGYAGYIDGGASQEEFYKFIKPILEKMDGTE ELLVKLNREDLLRKQRTFDNGSIPHQIHLGELHAILRRQEDFYPFLKDNREKIE KILTFRIPYYVGPLARGNSRFAWMTRKSEETITPWNFEEVVDKGASAQSFIERM TNFDKNLPNEKVLPKHSLLYEYFTVYNELTKVKYVTEGMRKPAFLSGEQKKAIV DLLFKTNRKVTVKQLKEDYFKKIECFDSVEISGVEDRENASLGTYHDLLKIIKD KDELDNEENEDILEDIVLTLTLFEDREMIEERLKTYAHLEDDKVMKQLKRRRYT GWGRLSRKLINGIRDKQSGKTILDELKSDGFANRNEMQLIHDDSLTFKEDIQKA QVSGQGDSLHEHIANLAGSPAIKKGILQTVKVVDELVKVMGRHKPENIVIEMAR ENQTTQKGQKNSRERMKRIEEGIKELGSQILKEHPVENTQLQNEKLYLYYLQNG RDMYVDQELDINRLSDYDVDAIVPQSFLKDDSIDNKVLTRSDKNRGKSDNVPSE EVVKKMKNYWRQLLNAKLITQRKFDNLTKAERGGLSELDKAGFIKRQLVETRQI TKHVAQILDSRMNTKYDENDKLIREVKVITLKSKLVSDERKDFQFYKVREINNY HHAHDAYLNAVVGTALIKKYPKLESEFVYGDYKVYDVRKMIAKSEQEIGKATAK YFFYSNIMNFFKTEITLANGEIRKRPLIETNGETGEIVWDKGRDFATVRKVLSM PQVNIVKKTEVQTGGFSKESILPKRNSDKLIARKKDWDPKKYGGEDSPTVAYSV LVVAKVEKGKSKKLKSVKELLGITIMERSSFEKNPIDFLEAKGYKEVKKDLIIK LPKYSLFELENGRKRMLASAGELQKGNELALPSKYVNFLYLASHYEKLKGSPED NEQKQLFVEQHKHYLDEIIEQISEFSKRVILADANLDKVLSAYNKHRDKPIREQ AENIIHLFTLTNLGAPAAFKYEDTTIDRKRYTSTKEVLDATLIHQSITGLYETR IDLSQLGGDSPKKKRKVGVDGSSGSETPGTSESATPESTGMNNSQGRVTFEDVT VNFTQGEWQRLNPEQRNLYRDVMLENYSNLVSVGQGETTKPDVILRLEQGKEPW LEEEEVLGSGRAEKNGDIGGQIWKPKDVKESLSAKRPAATKKAGQAKKK |

TABLE 19

Annotation of PLA003 amino acid sequence

| Name | Type | Minimum | Maximum | Length |
|---|---|---|---|---|
| SV40 NLS | CDS | 2 | 8 | 7 |
| SV40 NLS | CDS | 9 | 15 | 7 |
| DNMT3A | CDS | 17 | 317 | 301 |
| Linker | CDS | 318 | 344 | 27 |
| DNMT3L full-length | CDS | 345 | 730 | 386 |
| XTEN80 | CDS | 731 | 810 | 80 |
| dCas9 | CDS | 811 | 2180 | 1370 |
| NLS | CDS | 2181 | 2187 | 7 |
| XTEN16 | CDS | 2188 | 2208 | 21 |
| ZIM3 | CDS | 2211 | 2310 | 100 |
| SV40 NLS | CDS | 2313 | 2319 | 7 |
| SV40 NLS | CDS | 2320 | 2326 | 7 |

TABLE 20

Annotation of PLA003 polynucleotide sequence

| Name | Type | Minimum | Maximum | Length |
|---|---|---|---|---|
| SV40 NLS | CDS | 4 | 24 | 21 |
| SV40 NLS | CDS | 25 | 45 | 21 |
| DNMT3A | CDS | 49 | 951 | 903 |
| Linker | CDS | 952 | 1032 | 81 |
| DNMT3L full-length | CDS | 1033 | 2190 | 1158 |
| XTEN80 | CDS | 2191 | 2430 | 240 |
| dCas9 | CDS | 2431 | 6540 | 4110 |
| NLS | CDS | 6541 | 6561 | 21 |
| XTEN16 | CDS | 6562 | 6624 | 63 |
| ZIM3 | CDS | 6631 | 6930 | 300 |
| SV40 NLS | CDS | 6937 | 6957 | 21 |
| SV40 NLS | CDS | 6958 | 6978 | 21 |
| stop | terminator | 6979 | 6981 | 3 |

SEQUENCE LISTING (1263 sequences)

SEQ ID NO: 1 - DNA, 4107 bp, Streptococcus pyogenes
  source 1..4107: mol_type = genomic DNA
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1368 aa, Streptococcus pyogenes [sequence omitted]

SEQ ID NO: 3 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 4 - protein, 1300 aa, Francisella tularensis
  source 1..1300: note = subspecies: novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 5 - protein, 986 aa, unidentified
  source 1..986: note = CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 6 - protein, 1125 aa, unidentified
  source 1..1125: note = CasY sequence
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 7 - protein, 707 aa, unidentified
  source 1..707: note = CasPhi sequence
MADTPTLFTQFLRHHLPGQRFRKDILKQAGRILANKGEDATIAFLRGKSEESPPDFQPPVKCPIIACSRPLTEWPIYQASVAIQGYVYGQSLAEFEASDPGCSKDGLLGWFDKTGVCTDYFSVQGLNLIFQNARKRYIGVQTKVTNRNEKRHKKLKRINAKRIAEGLPELTSDEPESALDETGHLIDPPGLNTNIYCYQQVSPKPLALSEVNQLPTAYAGYSTSGDDPIQPMVTKDRLSISKGQPGYIPEHQRALLSQKKHRRMRGYGLKARALLVIVRIQDDWAVIDLRSLLRNAYWRRIVQTKEPSTITKLLKLVTGDPVLDATRMVATFTYKPGIVQVRSAKCLKNKQGSKLFSERYLNETVSVTSIDLGSNNLVAVATYRLVNGNTPELLQRFTLPSHLVKDFERYKQAHDTLEDSIQKTAVASLPQGQQTEIRMWSMYGFREAQERVCQELGLADGSIPWNVMTATSTILTDLFLARGGDPKKCMFTSEPKKKKNSKQVLYKIRDRAWAKMYRTLLSKETREAWNKALWGLKRGSPDYARLSKRKEELARRCVNYTISTAEKRAQCGRTIVALEDLNIGFFHGRGKQEPGWVGLFTRKKENRWLMQALHKAFLELAHHRGYHVIEVNPAYTSQTCPVCRHCDPDNRDQHNREAFHCIGCGFRGNADLDVATHNIAMVAITGESLKRARGSVASKTPQPLAAE

SEQ ID NO: 8 - protein, 426 aa, unidentified
  source 1..426: note = Cas12f1 (Cas14a) sequence
MIKVYRYEIVKPLDLDWKEFGTILRQLQQETRFALNKATQLAWEWMGFSSDYKDNHGEYPKSKDILGYTNVHGYAYHTIKTKAYRLNSGNLSQTIKRATDRFKAYQKEILRGDMSIPSYKRDIPLDLIKENISVNRMNHGDYIASLSLLSNPAKQEMNVKRKISVIIIVRGAGKTIMDRILSGEYQVSASQIIHDDRKNKWYLNISYDFEPQTRVLDLNKIMGIDLGVAVAVYMAFQHTPARYKLEGGEIENFRRQVESRRISMLRQGKYAGGARGGHGRDKRIKPIEQLRDKIANFRDTTNHRYSRYIVDMAIKEGCGTIQMEDLTNIRDIGSRFLQNWTYYDLQQKIIYKAEEAGIKVIKIDPQYTSQRCSECGNIDSGNRIGQAIFKCRACGYEANADYNAARNIAIPNIDKIIAESIKSGGS

SEQ ID NO: 9 - protein, 509 aa, unidentified
  source 1..509: note = Cas12f2 (Cas14b) sequence
NAMIAQKTIKIKLNPTKEQIIKLNSIIEEYIKVSNFTAKKIAEIQESFTDSGLTQGTCSECGKEKTYRKYHLLKKDNKLFCITCYKRKYSQFTLQKVEFQNKTGLRNVAKLPKTYYTNAIRFASDTFSGFDEIIKKKQNRLNSIQNRLNFWKELLYNPSNRNEIKIKVVKYAPKTDTREHPHYYSEAEIKGRIKRLEKQLKKFKMPKYPEFTSETISLQRELYSWKNPDELKISSITDKNESMNYYGKEYLKRYIDLINSQTPQILLEKENNSFYLCFPITKNIEMPKIDDTFEPVGIDWGITRNIAVVSILDSKTKKPKFVKFYSAGYILGKRKHYKSLRKHFGQKKRQDKINKLGTKEDRFIDSNIHKLAFLIVKEIRNHSNKPIILMENITDNREEAEKSMRQNILLHSVKSRLQNYIAYKALWNNIPTNLVKPEHTSQICNRCGHQDRENRPKGSKLFKCVKCNYMSNADFNASINIARKFYIGEYEPFYKDNEKMKSGVNSISM

SEQ ID NO: 10 - protein, 501 aa, unidentified
  source 1..501: note = Cas12f3 (Cas14c) sequence
MEVQKTVMKTLSLRILRPLYSQEIEKEIKEEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKHGHAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 11 - protein, 582 aa, unidentified
  source 1..582: note = C2c8 sequence
MKVLEFKIHPTEEQVSKIDQSLAACKLLWNLSIALKEESKQRYYRKKHKFDEFSPEIWGLSYSGHYDEKEFKTLKDKEKKLLIGNPCCKIAYFKKTSNGKEYTPLNSIPIRRFMNAENIDKDAVNYLNRKKLAFYFRENTAKFIGEIETEFKKGFFKSVIKPAYDAAKKGIRGIPRFKGRRDKVETLVNGQPETIKIKSNGVIVSSKIGLLKIRGLDRLQGKAPRMAKITRKATGYYLQLTIETDDTIYKESDKCVGLDMGAVAIFTDDLGRQSEAKRYAKIQKKRLNRLQRQASRQKDNSNNQRKTYAKLARVHEKIARQRKGRNAQLAHKITSEYQSVILEDLNLKNMTAAAKPKEREDGDGYKQNGKKRKSGLNKALLDNAIGQLRTFIENKANERGRKIIRVNPKHTSQTCPNCGNIDKANRVSQSKFKCVSCGYEAHADQNAAANILIRGLRDEFLRAIGSLYKFPVSMIGKYPGLAGEFTPDLDANQESIGDAPIENAEHSISKQMKQEGNRTPTQPENGSQSLIFLSAPPQPCGDSHGTNNPKALPNKASKRSSKKPRGAIPENPDQLTIWDLLD

SEQ ID NO: 12 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 13 - protein, 1053 aa, synthetic construct
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 14 - protein, 1300 aa, synthetic construct
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 15 - protein, 1082 aa, synthetic construct
MAAFKPNSINYILGLAIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDAALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 16 - protein, 984 aa, synthetic construct
MARILAFAIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDAIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 17 - protein, 1122 aa, synthetic construct
MGSDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDAILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 18 - protein, 1388 aa, synthetic construct
MTKPYSIGLAIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASARGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 19 - protein, 1228 aa, synthetic construct
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 20 - protein, 1307 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 21 - protein, 1307 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYRNRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNREKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 22 - protein, 1307 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYRNRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLALAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNREKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 23 - protein, 1307 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNVEKNRGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 24 - protein, 1307 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNKEKNNGAILFVKNGLYYLGIMPKQKGRYKALSFEPTEKTSEGFDKMYYDYFPDAAKMIPRCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 25 - protein, 986 aa, synthetic construct
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 26 - protein, 757 aa, synthetic construct
MPKPAVESEFSKVLKKHFPGERFRSSYMKRGGKILAAQGEEAVVAYLQGKSEEEPPNFQPPAKCHVVTKSRDFAEWPIMKASEAIQRYIYALSTTERAACKPGKSSESHAAWFAATGVSNHGYSHVQGLNLIFDHTLGRYDGVLKKVQLRNEKARARLESINASRADEGLPEIKAEEEEVATNETGHLLQPPGINPSFYVYQTISPQAYRPRDEIVLPPEYAGYVRDPNAPIPLGVVRNRCDIQKGCPGYIPEWQREAGTAISPKTGKAVTVPGLSPKKNKRMRRYWRSEKEKAQDALLVTVRIGTDWVVIDVRGLLRNARWRTIAPKDISLNALLDLFTGDPVIDVRRNIVTFTYTLDACGTYARKWTLKGKQTKATLDKLTATQTVALVAIALGQTNPISAGISRVTQENGALQCEPLDRFTLPDDLLKDISAYRIAWDRNEEELRARSVEALPEAQQAEVRALDGVSKETARTQLCADFGLDPKRLPWDKMSSNTTFISEALLSNSVSRDQVFFTPAPKKGAKKKAPVEVMRKDRTWARAYKPRLSVEAQKLKNEALWALKRTSPEYLKLSRRKEELCRRSINYVIEKTRRRTQCQIVIPVIEDLNVRFFHGSGKRLPGWDNFFTAKKENRWFIQGLHKAFSDLRTHRSFYVFEVRPERTSITCPKCGHCEVGNRDGEAFQCLSCGKTCNADLDVATHNLTQVALTGKTMPKREEPRDAQGTAPARKTKKASKSKAPPAEREDQTPAQEPSQTS

SEQ ID NO: 27 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 28 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 29 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 30 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 31 - protein, 1368 aa, synthetic construct
MDKKYSIGLAIGTNSVGWAVITDEYKVPSKKFKVLGNTDRHSIKKNLIGALLFDSGETAERTRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTRLGAPRAFKYFDTTIDPKQYRSTKEVLDATLIHQSITGLYETRIDLSQLGGD

SEQ ID NO: 32 - protein, 1053 aa, synthetic construct
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 33 - protein, 176 aa, synthetic construct
SRPGERPFQCRICMRNFSKKFNLLQHTRTHTGEKPFQCRICMRNFSRQDNLNSHLRTHTGSQKPFQCRICMRNFSRSHNLKLHTRTHTGEKPFQCRICMRNFSQSTTLKRHLRTHTGSQKPFQCRICMRNFSRNTNLTRHTRTHTGEKPFQCRICMRNFSIKHNLARHLRTHLRGS

SEQ ID NO: 34 - protein, 176 aa, synthetic construct
SRPGERPFQCRICMRNFSKKFNLLQHTRTHTGEKPFQCRICMRNFSRKDYLISHLRTHTGSQKPFQCRICMRNFSRSHNLKLHTRTHTGEKPFQCRICMRNFSQSTTLKRHLRTHTGSQKPFQCRICMRNFSRQDNLGRHLRTHTGEKPFQCRICMRNFSVVNNLNRHLKTHLRGS

SEQ ID NO: 35 - protein, 176 aa, synthetic construct
SRPGERPFQCRICMRNFSKKFNLLQHTRTHTGEKPFQCRICMRNFSRKDYLISHLRTHTGSQKPFQCRICMRNFSRSHNLRLHTRTHTGEKPFQCRICMRNFSQSTTLKRHLRTHTGSQKPFQCRICMRNFSRQDNLGRHLRTHTGEKPFQCRICMRNFSVVNNLNRHLKTHLRGS

SEQ ID NO: 36 - protein, 176 aa, synthetic construct
SRPGERPFQCRICMRNFSRRHILDRHTRTHTGEKPFQCRICMRNFSRQDNLGRHLRTHTGSQKPFQCRICMRNFSQSTTLKRHLRTHTGEKPFQCRICMRNFSRRDGLAGHLKTHTGSQKPFQCRICMRNFSVHHNLVRHLRTHTGEKPFQCRICMRNFSISHNLARHLKTHLRGS

SEQ ID NO: 37 - protein, 176 aa, synthetic construct
SRPGERPFQCRICMRNFSRREVLENHLRTHTGEKPFQCRICMRNFSRRDNLNRHLKTHTGSQKPFQCRICMRNFSQSTTLKRHLRTHTGEKPFQCRICMRNFSRRDGLAGHLKTHTGSQKPFQCRICMRNFSVHHNLVRHLRTHTGEKPFQCRICMRNFSISHNLARHLKTHLRGS

SEQ ID NO: 38 - protein, 176 aa, synthetic construct
SRPGERPFQCRICMRNFSRRAVLDRHTRTHTGEKPFQCRICMRNFSRQDNLGRHLRTHTGSQKPFQCRICMRNFSQSTTLKRHLRTHTGEKPFQCRICMRNFSRRDGLAGHLKTHTGSQKPFQCRICMRNFSVHHNLVRHLRTHTGEKPFQCRICMRNFSISHNLARHLKTHLRGS

SEQ ID NO: 39 - protein, 176 aa, synthetic construct
SRPGERPFQCRICMRNFSRQEHLVRHLRTHTGEKPFQCRICMRNFSEGGNLMRHLKTHTGSQKPFQCRICMRNFSSDRRDLDHTRTHTGEKPFQCRICMRNFSSFQSYLEHLRTHTGSQKPFQCRICMRNFSRPNHLAIHTRTHTGEKPFQCRICMRNFSQSPHLKRHLRTHLRGS

SEQ ID NO: 40 - protein, 176 aa, synthetic construct
SRPGERPFQCRICMRNFSRREHLVRHLRTHTGEKPFQCRICMRNFSDPSNLQRHLKTHTGSQKPFQCRICMRNFSSDRRDLDHTRTHTGEKPFQCRICMRNFSSFQSYLEHLRTHTGSQKPFQCRICMRNFSRPNHLAIHTRTHTGEKPFQCRICMRNFSQSPHLKRHLRTHLRGS

SEQ ID NO: 41 - protein, 176 aa, synthetic construct
SRPGERPFQCRICMRNFSRREHLVRHLRTHTGEKPFQCRICMRNFSDMGNLGRHLKTHTGSQKPFQCRICMRNFSSDRRDLDHTRTHTGEKPFQCRICMRNFSSFQSYLEHLRTHTGSQKPFQCRICMRNFSRPNHLAIHTRTHTGEKPFQCRICMRNFSQSPHLKRHLRTHLRGS

SEQ ID NO: 42 - protein, 179 aa, synthetic construct
SRPGERPFQCRICMRNFSKKDHLHRHTRTHTGEKPFQCRICMRNFSQKEILTRHLRTHTGSQKPFQCRICMRNFSQSAHLKRHLRTHTGEKPFQCRICMRNFSETGSLRRHLKTHTGGGGSQKPFQCRICMRNFSQSHSLKSHLRTHTGEKPFQCRICMRNFSESGHLKRHLKTHLRGS

SEQ ID NO: 43 - protein, 179 aa, synthetic construct
SRPGERPFQCRICMRNFSKKDHLHRHTRTHTGEKPFQCRICMRNFSQKEILTRHLRTHTGSQKPFQCRICMRNFSQSAHLKRHLRTHTGEKPFQCRICMRNFSDRTPLNRHLKTHTGGGGSQKPFQCRICMRNFSQSHSLKSHLRTHTGEKPFQCRICMRNFSESGHLKRHLKTHLRGS

SEQ ID NO: 44 - protein, 179 aa, synthetic construct
SRPGERPFQCRICMRNFSKTDHLARHTRTHTGEKPFQCRICMRNFSQKEILTRHLRTHTGSQKPFQCRICMRNFSQSAHLKRHLRTHTGEKPFQCRICMRNFSETGSLRRHLKTHTGGGGSQKPFQCRICMRNFSQKHHLVTHLRTHTGEKPFQCRICMRNFSENSKLRRHLKTHLRGS

SEQ ID NO: 45 - protein, 179 aa, synthetic construct
SRPGERPFQCRICMRNFSQAGNLVRHLRTHTGEKPFQCRICMRNFSQNSHLRRHLKTHTGGGGSQKPFQCRICMRNFSDLSTLRRHTRTHTGEKPFQCRICMRNFSQNEHLKVHLRTHTGSQKPFQCRICMRNFSGGTALRMHTRTHTGEKPFQCRICMRNFSQRSSLVRHLRTHLRGS

SEQ ID NO: 46 - protein, 179 aa, synthetic construct
SRPGERPFQCRICMRNFSQRGNLQRHLRTHTGEKPFQCRICMRNFSQTTHLSRHLKTHTGGGGSQKPFQCRICMRNFSDGSTLRRHTRTHTGEKPFQCRICMRNFSQKTHLAVHLRTHTGSQKPFQCRICMRNFSGGTALRMHTRTHTGEKPFQCRICMRNFSQRSSLVRHLRTHLRGS

SEQ ID NO: 47 - protein, 179 aa, synthetic construct
SRPGERPFQCRICMRNFSQRGNLQRHLRTHTGEKPFQCRICMRNFSQTTHLSRHLKTHTGGGGSQKPFQCRICMRNFSDLSTLRRHTRTHTGEKPFQCRICMRNFSQNEHLKVHLRTHTGSQKPFQCRICMRNFSGGSALSMHTRTHTGEKPFQCRICMRNFSQRSSLVRHLRTHLRGS

SEQ ID NO: 48 - protein, 179 aa, synthetic construct
SRPGERPFQCRICMRNFSDRGNLTRHLRTHTGEKPFQCRICMRNFSQARSLRAHLKTHTGGGGSQKPFQCRICMRNFSEKASLIKHTRTHTGEKPFQCRICMRNFSDHSSLKRHLRTHTGSQKPFQCRICMRNFSRRFILSRHTRTHTGEKPFQCRICMRNFSRNDSLKCHLRTHLRGS

SEQ ID NO: 49 - protein, 179 aa, synthetic construct
SRPGERPFQCRICMRNFSDRGNLTRHLRTHTGEKPFQCRICMRNFSQARSLRAHLKTHTGGGGSQKPFQCRICMRNFSDKSSLRKHTRTHTGEKPFQCRICMRNFSDHSSLKRHLRTHTGSQKPFQCRICMRNFSRNFILQRHTRTHTGEKPFQCRICMRNFSRNDTLIIHLRTHLRGS

SEQ ID NO: 50 - protein, 179 aa, synthetic construct
SRPGERPFQCRICMRNFSDRGNLTRHLRTHTGEKPFQCRICMRNFSQARSLRAHLKTHTGGGGSQKPFQCRICMRNFSCNGSLKKHTRTHTGEKPFQCRICMRNFSDHSSLKRHLRTHTGSQKPFQCRICMRNFSRNFILQRHTRTHTGEKPFQCRICMRNFSRNDTLIIHLRTHLRGS

SEQ ID NO: 51 - protein, 179 aa, synthetic construct
SRPGERPFQCRICMRNFSRTDTLARHLRTHTGEKPFQCRICMRNFSRTDSLPRHLKTHTGGGGSQKPFQCRICMRNFSDHSSLKRHLRTHTGEKPFQCRICMRNFSQPHGLAHHLKTHTGSQKPFQCRICMRNFSQSAHLKRHLRTHTGEKPFQCRICMRNFSVGNSLSRHLKTHLRGS

SEQ ID NO: 52 - protein, 179 aa, synthetic construct
SRPGERPFQCRICMRNFSRTDTLARHLRTHTGEKPFQCRICMRNFSRTDSLPRHLKTHTGGGGSQKPFQCRICMRNFSDHSSLKRHLRTHTGEKPFQCRICMRNFSQPHGLRHHLKTHTGSQKPFQCRICMRNFSQSAHLKRHLRTHTGEKPFQCRICMRNFSVGNSLSRHLKTHLRGS

SEQ ID NO: 53 - protein, 179 aa, synthetic construct
SRPGERPFQCRICMRNFSRTDTLARHLRTHTGEKPFQCRICMRNFSRLDMLARHLKTHTGGGGSQKPFQCRICMRNFSDHSSLKRHLRTHTGEKPFQCRICMRNFSQPHGLSTHLKTHTGSQKPFQCRICMRNFSQQAHLVRHTRTHTGEKPFQCRICMRNFSVHESLKRHLRTHLRGS

SEQ ID NO: 54 - protein, 176 aa, synthetic construct
SRPGERPFQCRICMRNFSRADNLGRHLRTHTGEKPFQCRICMRNFSRNTHLSYHLKTHTGSQKPFQCRICMRNFSRGDGLRRHLRTHTGEKPFQCRICMRNFSRRDNLNRHLKTHTGSQKPFQCRICMRNFSRARNLTLHTRTHTGEKPFQCRICMRNFSDPSSLKRHLRTHLRGS

SEQ ID NO: 55 - protein, 176 aa, synthetic construct
SRPGERPFQCRICMRNFSRADNLGRHLRTHTGEKPFQCRICMRNFSRNTHLSYHLKTHTGSQKPFQCRICMRNFSRKLGLLRHTRTHTGEKPFQCRICMRNFSRQDNLGRHLRTHTGSQKPFQCRICMRNFSRARNLTLHTRTHTGEKPFQCRICMRNFSDPSSLKRHLRTHLRGS

SEQ ID NO: 56 - protein, 176 aa, synthetic construct
SRPGERPFQCRICMRNFSRADNLGRHLRTHTGEKPFQCRICMRNFSRNTHLSYHLKTHTGSQKPFQCRICMRNFSRKLGLLRHTRTHTGEKPFQCRICMRNFSRQDNLGRHLRTHTGSQKPFQCRICMRNFSRRRNLQLHTRTHTGEKPFQCRICMRNFSDHSSLKRHLRTHLRGS

SEQ ID NO: 57 - protein, 179 aa, synthetic construct
SRPGERPFQCRICMRNFSQQSSLLRHTRTHTGEKPFQCRICMRNFSRREHLVRHLRTHTGSQKPFQCRICMRNFSGLTALRTHTRTHTGEKPFQCRICMRNFSERAKLIRHLRTHTGGGGSQKPFQCRICMRNFSAKRDLDRHTRTHTGEKPFQCRICMRNFSVNSSLTRHLRTHLRGS

SEQ ID NO: 58 - protein, 179 aa, synthetic construct
SRPGERPFQCRICMRNFSQQSSLLRHTRTHTGEKPFQCRICMRNFSRREHLVRHLRTHTGSQKPFQCRICMRNFSGLTALRTHTRTHTGEKPFQCRICMRNFSERAKLIRHLRTHTGGGGSQKPFQCRICMRNFSLRKDLVRHTRTHTGEKPFQCRICMRNFSVRHSLTRHLRTHLRGS

SEQ ID NO: 59 - protein, 179 aa, synthetic construct
SRPGERPFQCRICMRNFSQASALSRHTRTHTGEKPFQCRICMRNFSRREHLVRHLRTHTGSQKPFQCRICMRNFSGLTALRTHTRTHTGEKPFQCRICMRNFSERAKLIRHLRTHTGGGGSQKPFQCRICMRNFSAKRDLDRHTRTHTGEKPFQCRICMRNFSVNSSLTRHLRTHLRGS

SEQ ID NO: 60 - protein, 179 aa, synthetic construct
SRPGERPFQCRICMRNFSRGRNLEMHTRTHTGEKPFQCRICMRNFSDSSVLRRHLRTHTGGGGSQKPFQCRICMRNFSQNANLKRHTRTHTGEKPFQCRICMRNFSQKHHLAVHLRTHTGSQKPFQCRICMRNFSQRSNLARHLRTHTGEKPFQCRICMRNFSQKVHLEAHLKTHLRGS

SEQ ID NO: 61 - protein, 179 aa, synthetic construct
SRPGERPFQCRICMRNFSRRRNLDVHTRTHTGEKPFQCRICMRNFSDSSVLRRHLRTHTGGGGSQKPFQCRICMRNFSQNANLKRHTRTHTGEKPFQCRICMRNFSQKHHLAVHLRTHTGSQKPFQCRICMRNFSQRSNLARHLRTHTGEKPFQCRICMRNFSQKVHLEAHLKTHLRGS

SEQ ID NO: 62 - protein, 179 aa, synthetic construct
SRPGERPFQCRICMRNFSRGRNLAIHTRTHTGEKPFQCRICMRNFSDSSVLRRHLRTHTGGGGSQKPFQCRICMRNFSLKSNLHRHTRTHTGEKPFQCRICMRNFSLKQHLVVHLRTHTGSQKPFQCRICMRNFSLKTNLARHTRTHTGEKPFQCRICMRNFSQKCHLKAHLRTHLRGS

SEQ ID NO: 63 - protein, 179 aa, synthetic construct
SRPGERPFQCRICMRNFSDGSNLRRHLRTHTGEKPFQCRICMRNFSRIDNLDGHLKTHTGSQKPFQCRICMRNFSQRRYLVEHTRTHTGEKPFQCRICMRNFSQQTNLARHLRTHTGGGGSQKPFQCRICMRNFSQRSDLTRHLRTHTGEKPFQCRICMRNFSRGDNLNRHLKTHLRGS

SEQ ID NO: 64 - protein, 179 aa, synthetic construct
SRPGERPFQCRICMRNFSDPSNLQRHLRTHTGEKPFQCRICMRNFSRRDNLPKHLKTHTGSQKPFQCRICMRNFSTTFNLRVHTRTHTGEKPFQCRICMRNFSQTQNLTRHLRTHTGGGGSQKPFQCRICMRNFSHKETLNRHLRTHTGEKPFQCRICMRNFSREDNLGRHLKTHLRGS

SEQ ID NO: 65 - protein, 179 aa, synthetic construct
SRPGERPFQCRICMRNFSDPSNLQRHLRTHTGEKPFQCRICMRNFSRRDNLPKHLKTHTGSQKPFQCRICMRNFSQRRYLVEHTRTHTGEKPFQCRICMRNFSQQTNLARHLRTHTGGGGSQKPFQCRICMRNFSQRSDLTRHLRTHTGEKPFQCRICMRNFSRGDNLNRHLKTHLRGS

SEQ ID NO: 66 - protein, 176 aa, synthetic construct
SRPGERPFQCRICMRNFSQQTNLTRHLRTHTGEKPFQCRICMRNFSANRTLVHHLKTHTGSQKPFQCRICMRNFSEEANLRRHTRTHTGEKPFQCRICMRNFSRGEHLTRHLRTHTGSQKPFQCRICMRNFSTNSSLTRHLRTHTGEKPFQCRICMRNFSRIDNLIRHLKTHLRGS

SEQ ID NO: 67 - protein, 176 aa, synthetic construct
SRPGERPFQCRICMRNFSQQTNLTRHLRTHTGEKPFQCRICMRNFSANRTLVHHLKTHTGSQKPFQCRICMRNFSEEANLRRHTRTHTGEKPFQCRICMRNFSRREHLVRHLRTHTGSQKPFQCRICMRNFSMTSSLRRHTRTHTGEKPFQCRICMRNFSRQDNLGRHLRTHLRGS

SEQ ID NO: 68 - protein, 176 aa, synthetic construct
SRPGERPFQCRICMRNFSQQTNLTRHLRTHTGEKPFQCRICMRNFSANRTLVHHLKTHTGSQKPFQCRICMRNFSEEANLRRHTRTHTGEKPFQCRICMRNFSRGEHLTRHLRTHTGSQKPFQCRICMRNFSMTSSLRRHTRTHTGEKPFQCRICMRNFSRQDNLGRHLRTHLRGS

SEQ ID NO: 69 - protein, 176 aa, synthetic construct
SRPGERPFQCRICMRNFSRATHLTRHTRTHTGEKPFQCRICMRNFSRADVLKGHLRTHTGSQKPFQCRICMRNFSQRSSLVRHLRTHTGEKPFQCRICMRNFSRKDALHVHLKTHTGSQKPFQCRICMRNFSVHHNLVRHLRTHTGEKPFQCRICMRNFSISHNLARHLKTHLRGS

SEQ ID NO: 70 - protein, 176 aa, synthetic construct
SRPGERPFQCRICMRNFSRATHLTRHTRTHTGEKPFQCRICMRNFSRADVLKGHLRTHTGSQKPFQCRICMRNFSQSSSLVRHLRTHTGEKPFQCRICMRNFSRKERLATHLKTHTGSQKPFQCRICMRNFSVRHNLTRHLRTHTGEKPFQCRICMRNFSISHNLARHLKTHLRGS

SEQ ID NO: 71 - protein, 176 aa, synthetic construct
SRPGERPFQCRICMRNFSKKDHLHRHTRTHTGEKPFQCRICMRNFSRKESLTVHLRTHTGSQKPFQCRICMRNFSQSSSLVRHLRTHTGEKPFQCRICMRNFSRKERLATHLKTHTGSQKPFQCRICMRNFSVHHNLVRHLRTHTGEKPFQCRICMRNFSISHNLARHLKTHLRGS

SEQ ID NO: 72 - protein, 179 aa, synthetic construct
SRPGERPFQCRICMRNFSRVDHLHRHLRTHTGEKPFQCRICMRNFSRREHLSGHLKTHTGGGGSQKPFQCRICMRNFSQSSSLVRHLRTHTGEKPFQCRICMRNFSRKERLATHLKTHTGSQKPFQCRICMRNFSVAHNLTRHLRTHTGEKPFQCRICMRNFSISHNLARHLKTHLRGS

SEQ ID NO: 73 - protein, 179 aa, synthetic construct
SRPGERPFQCRICMRNFSRKHHLGRHTRTHTGEKPFQCRICMRNFSRREHLTIHLRTHTGGGGSQKPFQCRICMRNFSQSSSLVRHLRTHTGEKPFQCRICMRNFSRKERLATHLKTHTGSQKPFQCRICMRNFSVAHNLTRHLRTHTGEKPFQCRICMRNFSISHNLARHLKTHLRGS

SEQ ID NO: 74 - protein, 179 aa, synthetic construct
SRPGERPFQCRICMRNFSRVDHLHRHLRTHTGEKPFQCRICMRNFSRSDHLSLHLKTHTGGGGSQKPFQCRICMRNFSQSSSLVRHLRTHTGEKPFQCRICMRNFSRKERLATHLKTHTGSQKPFQCRICMRNFSVAHNLTRHLRTHTGEKPFQCRICMRNFSISHNLARHLKTHLRGS

SEQ ID NO: 75 - protein, 176 aa, synthetic construct
SRPGERPFQCRICMRNFSKTDHLARHTRTHTGEKPFQCRICMRNFSQKEILTRHLRTHTGSQKPFQCRICMRNFSQSAHLKRHLRTHTGEKPFQCRICMRNFSETGSLRRHLKTHTGSQKPFQCRICMRNFSQSSSLVRHLRTHTGEKPFQCRICMRNFSQTNTLGRHLKTHLRGS

SEQ ID NO: 76 - protein, 176 aa, synthetic construct
SRPGERPFQCRICMRNFSKKDHLHRHTRTHTGEKPFQCRICMRNFSQKEILTRHLRTHTGSQKPFQCRICMRNFSQSAHLKRHLRTHTGEKPFQCRICMRNFSETGSLRRHLKTHTGSQKPFQCRICMRNFSQSSSLVRHLRTHTGEKPFQCRICMRNFSQGGTLRRHLKTHLRGS

SEQ ID NO: 77 - protein, 176 aa, synthetic construct
SRPGERPFQCRICMRNFSKKDHLHRHTRTHTGEKPFQCRICMRNFSQKEILTRHLRTHTGSQKPFQCRICMRNFSQSAHLKRHLRTHTGEKPFQCRICMRNFSDPTSLNRHLKTHTGSQKPFQCRICMRNFSQSSSLVRHLRTHTGEKPFQCRICMRNFSQTNTLGRHLKTHLRGS

SEQ ID NO: 78 - protein, 176 aa, synthetic construct
SRPGERPFQCRICMRNFSQQTNLTRHLRTHTGEKPFQCRICMRNFSVGGNLARHLKTHTGSQKPFQCRICMRNFSKRYNLYQHTRTHTGEKPFQCRICMRNFSRQDNLNTHLRTHTGSQKPFQCRICMRNFSRSHNLKLHTRTHTGEKPFQCRICMRNFSQSTTLKRHLRTHLRGS

SEQ ID NO: 79 - protein, 176 aa, synthetic construct
SRPGERPFQCRICMRNFSQQTNLTRHLRTHTGEKPFQCRICMRNFSVGGNLSRHLKTHTGSQKPFQCRICMRNFSKRYNLYQHTRTHTGEKPFQCRICMRNFSRQDNLNTHLRTHTGSQKPFQCRICMRNFSRSHNLRLHTRTHTGEKPFQCRICMRNFSQSTTLKRHLRTHLRGS

SEQ ID NO: 80 - protein, 176 aa, synthetic construct
SRPGERPFQCRICMRNFSQQTNLTRHLRTHTGEKPFQCRICMRNFSVGGNLSRHLKTHTGSQKPFQCRICMRNFSKKFNLLQHTRTHTGEKPFQCRICMRNFSRRDNLKSHLRTHTGSQKPFQCRICMRNFSRSHNLKLHTRTHTGEKPFQCRICMRNFSQSTTLKRHLRTHLRGS

SEQ ID NO: 81 - protein, 179 aa, synthetic construct
SRPGERPFQCRICMRNFSDKSSLRKHTRTHTGEKPFQCRICMRNFSDHSSLKRHLRTHTGSQKPFQCRICMRNFSRNFILQRHTRTHTGEKPFQCRICMRNFSRNDTLIIHLRTHTGGGGSQKPFQCRICMRNFSTSTLLKRHTRTHTGEKPFQCRICMRNFSLKEHLTRHLRTHLRGS

SEQ ID NO: 82 - protein, 179 aa, synthetic construct
SRPGERPFQCRICMRNFSCNGSLKKHTRTHTGEKPFQCRICMRNFSDHSSLKRHLRTHTGSQKPFQCRICMRNFSRNFILARHTRTHTGEKPFQCRICMRNFSRQDILVVHLRTHTGGGGSQKPFQCRICMRNFSHKSSLTRHLRTHTGEKPFQCRICMRNFSESGHLKRHLKTHLRGS

SEQ ID NO: 83 - protein, 179 aa, synthetic construct
SRPGERPFQCRICMRNFSCNGSLKKHTRTHTGEKPFQCRICMRNFSDHSSLKRHLRTHTGSQKPFQCRICMRNFSRNFILARHTRTHTGEKPFQCRICMRNFSRQDILVVHLRTHTGGGGSQKPFQCRICMRNFSTSTLLKRHTRTHTGEKPFQCRICMRNFSLKEHLTRHLRTHLRGS

SEQ ID NO: 84 - protein, 176 aa, synthetic construct
SRPGERPFQCRICMRNFSTNNNLARHTRTHTGEKPFQCRICMRNFSRTDSLTLHLRTHTGSQKPFQCRICMRNFSQREHLTTHLRTHTGEKPFQCRICMRNFSRRDNLNRHLKTHTGSQKPFQCRICMRNFSRRQKLTIHTRTHTGEKPFQCRICMRNFSHKSSLTRHLRTHLRGS

SEQ ID NO: 85 - protein, 176 aa, synthetic construct
SRPGERPFQCRICMRNFSTNNNLARHTRTHTGEKPFQCRICMRNFSRTDSLTLHLRTHTGSQKPFQCRICMRNFSQREHLTTHLRTHTGEKPFQCRICMRNFSRGDNLKRHLKTHTGSQKPFQCRICMRNFSRRQKLTIHTRTHTGEKPFQCRICMRNFSHKSSLTRHLRTHLRGS

SEQ ID NO: 86 - protein, 176 aa, synthetic construct
SRPGERPFQCRICMRNFSTNNNLARHTRTHTGEKPFQCRICMRNFSRTDSLTLHLRTHTGSQKPFQCRICMRNFSQREHLNGHLRTHTGEKPFQCRICMRNFSRGDNLARHLKTHTGSQKPFQCRICMRNFSRRQKLTIHTRTHTGEKPFQCRICMRNFSHKSSLTRHLRTHLRGS

SEQ ID NO: 87 - protein, 179 aa, synthetic construct
SRPGERPFQCRICMRNFSQQTNLTRHLRTHTGEKPFQCRICMRNFSANRTLVHHLKTHTGSQKPFQCRICMRNFSDPANLRRHTRTHTGEKPFQCRICMRNFSRQEHLVRHLRTHTGGGGSQKPFQCRICMRNFSMKHHLGRHLRTHTGEKPFQCRICMRNFSQNSHLRRHLKTHLRGS

SEQ ID NO: 88 - protein, 179 aa, synthetic construct
SRPGERPFQCRICMRNFSQQTNLTRHLRTHTGEKPFQCRICMRNFSANRTLVHHLKTHTGSQKPFQCRICMRNFSEEANLRRHTRTHTGEKPFQCRICMRNFSRREHLVRHLRTHTGGGGSQKPFQCRICMRNFSMKHHLGRHLRTHTGEKPFQCRICMRNFSQNSHLRRHLKTHLRGS

SEQ ID NO: 89 - protein, 179 aa, synthetic construct
SRPGERPFQCRICMRNFSQQTNLTRHLRTHTGEKPFQCRICMRNFSANRTLVHHLKTHTGSQKPFQCRICMRNFSDPANLRRHTRTHTGEKPFQCRICMRNFSRQEHLVRHLRTHTGGGGSQKPFQCRICMRNFSLKQHLVRHLRTHTGEKPFQCRICMRNFSQGGHLARHLKTHLRGS

SEQ ID NO: 90 - protein, 179 aa, synthetic construct
SRPGERPFQCRICMRNFSRNTHLARHTRTHTGEKPFQCRICMRNFSRADVLKGHLRTHTGSQKPFQCRICMRNFSQRSSLVRHLRTHTGEKPFQCRICMRNFSRKDALHVHLKTHTGGGGSQKPFQCRICMRNFSQNEHLKVHLRTHTGEKPFQCRICMRNFSQNSHLRRHLKTHLRGS

SEQ ID NO: 91 - protein, 179 aa, synthetic construct
SRPGERPFQCRICMRNFSRNTHLARHTRTHTGEKPFQCRICMRNFSRADVLKGHLRTHTGSQKPFQCRICMRNFSQSSSLVRHLRTHTGEKPFQCRICMRNFSRKERLATHLKTHTGGGGSQKPFQCRICMRNFSQKTHLAVHLRTHTGEKPFQCRICMRNFSQGGHLKRHLKTHLRGS

SEQ ID NO: 92 - protein, 179 aa, synthetic construct
SRPGERPFQCRICMRNFSRNTHLARHTRTHTGEKPFQCRICMRNFSRADVLKGHLRTHTGSQKPFQCRICMRNFSQSSSLVRHLRTHTGEKPFQCRICMRNFSRKERLATHLKTHTGGGGSQKPFQCRICMRNFSQKTHLAVHLRTHTGEKPFQCRICMRNFSQNSHLRRHLKTHLRGS

SEQ ID NO: 93 - protein, 176 aa, synthetic construct
SRPGERPFQCRICMRNFSHKSSLTRHLRTHTGEKPFQCRICMRNFSESGHLKRHLKTHTGSQKPFQCRICMRNFSRRRNLTLHTRTHTGEKPFQCRICMRNFSDRSSLKRHLRTHTGSQKPFQCRICMRNFSQPHSLAVHLRTHTGEKPFQCRICMRNFSQKPHLSRHLKTHLRGS

SEQ ID NO: 94 - protein, 176 aa, synthetic construct
SRPGERPFQCRICMRNFSHKSSLTRHLRTHTGEKPFQCRICMRNFSEGGHLKRHLKTHTGSQKPFQCRICMRNFSRRRNLQLHTRTHTGEKPFQCRICMRNFSDHSSLKRHLRTHTGSQKPFQCRICMRNFSRRQHLQYHTRTHTGEKPFQCRICMRNFSQSAHLKRHLRTHLRGS

SEQ ID NO: 95 - protein, 176 aa, synthetic construct
SRPGERPFQCRICMRNFSHKSSLTRHLRTHTGEKPFQCRICMRNFSEGGHLKRHLKTHTGSQKPFQCRICMRNFSRRRNLTLHTRTHTGEKPFQCRICMRNFSDRSSLKRHLRTHTGSQKPFQCRICMRNFSRRQHLQYHTRTHTGEKPFQCRICMRNFSQSAHLKRHLRTHLRGS

SEQ ID NO: 96 - protein, 179 aa, synthetic construct
SRPGERPFQCRICMRNFSGHTALRNHTRTHTGEKPFQCRICMRNFSQSGTLHRHLRTHTGGGGSQKPFQCRICMRNFSDHSSLKRHLRTHTGEKPFQCRICMRNFSAMRSLMGHLKTHTGSQKPFQCRICMRNFSRRSRLVRHTRTHTGEKPFQCRICMRNFSRGEHLTRHLRTHLRGS

SEQ ID NO: 97 - protein, 179 aa, synthetic construct
SRPGERPFQCRICMRNFSGHTALRNHTRTHTGEKPFQCRICMRNFSQSTTLKRHLRTHTGGGGSQKPFQCRICMRNFSDHSSLKRHLRTHTGEKPFQCRICMRNFSQQRSLVGHLKTHTGSQKPFQCRICMRNFSEAHHLSRHLRTHTGEKPFQCRICMRNFSRTEHLARHLKTHLRGS

SEQ ID NO: 98 - protein, 179 aa, synthetic construct
SRPGERPFQCRICMRNFSGHTALRNHTRTHTGEKPFQCRICMRNFSQSTTLKRHLRTHTGGGGSQKPFQCRICMRNFSDHSSLKRHLRTHTGEKPFQCRICMRNFSAMRSLMGHLKTHTGSQKPFQCRICMRNFSRQSRLQRHTRTHTGEKPFQCRICMRNFSRREHLVRHLRTHLRGS

SEQ ID NO: 99 - protein, 179 aa, synthetic construct
SRPGERPFQCRICMRNFSQGETLKRHLRTHTGEKPFQCRICMRNFSRADNLRRHLKTHTGSQKPFQCRICMRNFSDKANLTRHLRTHTGEKPFQCRICMRNFSDQGNLIRHLKTHTGGGGSQKPFQCRICMRNFSHRHVLINHTRTHTGEKPFQCRICMRNFSTNSSLTRHLRTHLRGS

SEQ ID NO: 100 - protein, 179 aa, synthetic construct
SRPGERPFQCRICMRNFSQGETLKRHLRTHTGEKPFQCRICMRNFSRADNLRRHLKTHTGSQKPFQCRICMRNFSDSSNLRRHLRTHTGEKPFQCRICMRNFSDQGNLIRHLKTHTGGGGSQKPFQCRICMRNFSHKSSLTRHLRTHTGEKPFQCRICMRNFSIRTSLKRHLKTHLRGS

SEQ ID NO: 101 - protein, 179 aa, synthetic construct
SRPGERPFQCRICMRNFSQGETLKRHLRTHTGEKPFQCRICMRNFSRADNLRRHLKTHTGSQKPFQCRICMRNFSEQGNLLRHLRTHTGEKPFQCRICMRNFSDGGNLGRHLKTHTGGGGSQKPFQCRICMRNFSHRHVLINHTRTHTGEKPFQCRICMRNFSTNSSLTRHLRTHLRGS

SEQ ID NO: 102 - DNA, 18 bp, Hepatitis B virus
  source 1..18: mol_type = genomic DNA
gatgaggcatagcagcag

SEQ ID NO: 103 - DNA, 18 bp, Hepatitis B virus
  source 1..18: mol_type = genomic DNA
gatgattaggcagaggtg

SEQ ID NO: 104 - DNA, 18 bp, Hepatitis B virus
  source 1..18: mol_type = genomic DNA
ggattcagcgccgacggg

SEQ ID NO: 105 - DNA, 19 bp, Hepatitis B virus
  source 1..19: mol_type = genomic DNA
ggcagtagtcggaacaggg

SEQ ID NO: 106 - DNA, 19 bp, Hepatitis B virus
  source 1..19: mol_type = genomic DNA
gtaaactgagccaggagaa

SEQ ID NO: 107 - DNA, 19 bp, Hepatitis B virus
  source 1..19: mol_type = genomic DNA
acggtggtctccatgcgac

SEQ ID NO: 108 - DNA, 19 bp, Hepatitis B virus
  source 1..19: mol_type = genomic DNA
gctggatgtgtctgcggcg

SEQ ID NO: 109 - DNA, 18 bp, Hepatitis B virus
  source 1..18: mol_type = genomic DNA
gtctgcgaggcgagggag

SEQ ID NO: 110 - DNA, 19 bp, Hepatitis B virus
  source 1..19: mol_type = genomic DNA
gttgccgggcaacggggta

SEQ ID NO: 111 - DNA, 19 bp, Hepatitis B virus
  source 1..19: mol_type = genomic DNA
cgagaaagtgaaagcctgc

SEQ ID NO: 112 - DNA, 19 bp, Hepatitis B virus
  source 1..19: mol_type = genomic DNA
gaggcttgaacagtaggac

SEQ ID NO: 113 - DNA, 18 bp, Hepatitis B virus
  source 1..18: mol_type = genomic DNA
gaggttggggactgcgaa

SEQ ID NO: 114 - DNA, 18 bp, Hepatitis B virus
  source 1..18: mol_type = genomic DNA
gatgatgtggtattgggg

SEQ ID NO: 115 - DNA, 19 bp, Hepatitis B virus
  source 1..19: mol_type = genomic DNA
gatgatgtggtattggggg

SEQ ID NO: 116 - DNA, 18 bp, Hepatitis B virus
  source 1..18: mol_type = genomic DNA
gcagtagtcggaacaggg

SEQ ID NO: 117 - DNA, 18 bp, Hepatitis B virus
  source 1..18: mol_type = genomic DNA
gcatagcagcaggatgaa

SEQ ID NO: 118 - DNA, 19 bp, Hepatitis B virus
  source 1..19: mol_type = genomic DNA
ggcgttcacggtggtctcc

SEQ ID NO: 119 - DNA, 18 bp, Hepatitis B virus
  source 1..18: mol_type = genomic DNA
gttggtgagtgattggag

SEQ ID NO: 120 - DNA, 19 bp, Hepatitis B virus
  source 1..19: mol_type = genomic DNA
ggaggttggggactgcgaa

SEQ ID NO: 121 - DNA, 19 bp, Hepatitis B virus
  source 1..19: mol_type = genomic DNA
ggatgatgtggtattgggg

SEQ ID NO: 122 - DNA, 18 bp, Hepatitis B virus
  source 1..18: mol_type = genomic DNA
ggatgtgtctgcggcgtt

SEQ ID NO: 123 - DNA, 19 bp, Hepatitis B virus
  source 1..19: mol_type = genomic DNA
gggggttgcgtcagcaaac

SEQ ID NO: 124 - DNA, 19 bp, Hepatitis B virus
  source 1..19: mol_type = genomic DNA
gttgttagacgacgaggca

SEQ ID NO: 125 - protein, 7 aa, synthetic construct
KKFNLLQ

SEQ ID NO: 126 - protein, 7 aa, synthetic construct
RRHILDR

SEQ ID NO: 127 - protein, 7 aa, synthetic construct
RREVLEN

SEQ ID NO: 128 - protein, 7 aa, synthetic construct
RRAVLDR

SEQ ID NO: 129 - protein, 7 aa, synthetic construct
RQEHLVR

SEQ ID NO: 130 - protein, 7 aa, synthetic construct
RREHLVR

SEQ ID NO: 131 - protein, 7 aa, synthetic construct
KKDHLHR

SEQ ID NO: 132 - protein, 7 aa, synthetic construct
KTDHLAR

SEQ ID NO: 133 - protein, 7 aa, synthetic construct
QAGNLVR

SEQ ID NO: 134 - protein, 7 aa, synthetic construct
QRGNLQR

SEQ ID NO: 135 - protein, 7 aa, synthetic construct
DRGNLTR

SEQ ID NO: 136 - protein, 7 aa, synthetic construct
RTDTLAR

SEQ ID NO: 137 - protein, 7 aa, synthetic construct
RADNLGR

SEQ ID NO: 138 - protein, 7 aa, synthetic construct
QQSSLLR

SEQ ID NO: 139 - protein, 7 aa, synthetic construct
QASALSR

SEQ ID NO: 140 - protein, 7 aa, synthetic construct
RGRNLEM

SEQ ID NO: 141 - protein, 7 aa, synthetic construct
RRRNLDV

SEQ ID NO: 142 - protein, 7 aa, synthetic construct
RGRNLAI

SEQ ID NO: 143 - protein, 7 aa, synthetic construct
DGSNLRR

SEQ ID NO: 144 - protein, 7 aa, synthetic construct
DPSNLQR

SEQ ID NO: 145 - protein, 7 aa, synthetic construct
QQTNLTR

SEQ ID NO: 146 - protein, 7 aa, synthetic construct
RATHLTR

SEQ ID NO: 147 - protein, 7 aa, synthetic construct
RVDHLHR

SEQ ID NO: 148 - protein, 7 aa, synthetic construct
RKHHLGR

SEQ ID NO: 149 - protein, 7 aa, synthetic construct
DKSSLRK

SEQ ID NO: 150 - protein, 7 aa, synthetic construct
CNGSLKK

SEQ ID NO: 151 - protein, 7 aa, synthetic construct
TNNNLAR

SEQ ID NO: 152 - protein, 7 aa, synthetic construct
RNTHLAR

SEQ ID NO: 153 - protein, 7 aa, synthetic construct
HKSSLTR

SEQ ID NO: 154 - protein, 7 aa, synthetic construct
GHTALRN

SEQ ID NO: 155 - protein, 7 aa, synthetic construct
QGETLKR

SEQ ID NO: 156 - protein, 7 aa, synthetic construct
RQDNLNS

SEQ ID NO: 157 - protein, 7 aa, synthetic construct
RKDYLIS

SEQ ID NO: 158 - protein, 7 aa, synthetic construct
RQDNLGR

SEQ ID NO: 159 - protein, 7 aa, synthetic construct
RRDNLNR

SEQ ID NO: 160 - protein, 7 aa, synthetic construct
EGGNLMR

SEQ ID NO: 161 - protein, 7 aa, synthetic construct
DPSNLQR

SEQ ID NO: 162 - protein, 7 aa, synthetic construct
DMGNLGR

SEQ ID NO: 163 - protein, 7 aa, synthetic construct
QKEILTR

SEQ ID NO: 164 - protein, 7 aa, synthetic construct
QNSHLRR

SEQ ID NO: 165 - protein, 7 aa, synthetic construct
QTTHLSR

SEQ ID NO: 166 - protein, 7 aa, synthetic construct
QARSLRA

SEQ ID NO: 167 - protein, 7 aa, synthetic construct
RTDSLPR

SEQ ID NO: 168 - protein, 7 aa, synthetic construct
RLDMLAR

SEQ ID NO: 169 - protein, 7 aa, synthetic construct
RNTHLSY

SEQ ID NO: 170 - protein, 7 aa, synthetic construct
RREHLVR

SEQ ID NO: 171 - protein, 7 aa, synthetic construct
DSSVLRR

SEQ ID NO: 172 - protein, 7 aa, synthetic construct
RIDNLDG

SEQ ID NO: 173 - protein, 7 aa, synthetic construct
RRDNLPK

SEQ ID NO: 174 - protein, 7 aa, synthetic construct
ANRTLVH

SEQ ID NO: 175 - protein, 7 aa, synthetic construct
RADVLKG

SEQ ID NO: 176 - protein, 7 aa, synthetic construct
RKESLTV

SEQ ID NO: 177 - protein, 7 aa, synthetic construct
RREHLSG

SEQ ID NO: 178 - protein, 7 aa, synthetic construct
RREHLTI

SEQ ID NO: 179 - protein, 7 aa, synthetic construct
RSDHLSL

SEQ ID NO: 180 - protein, 7 aa, synthetic construct
VGGNLAR

SEQ ID NO: 181 - protein, 7 aa, synthetic construct
VGGNLSR

SEQ ID NO: 182 - protein, 7 aa, synthetic construct
DHSSLKR

SEQ ID NO: 183 - protein, 7 aa, synthetic construct
RTDSLTL

SEQ ID NO: 184 - protein, 7 aa, synthetic construct
ESGHLKR

SEQ ID NO: 185 - protein, 7 aa, synthetic construct
EGGHLKR

SEQ ID NO: 186 - protein, 7 aa, synthetic construct
QSGTLHR

SEQ ID NO: 187 - protein, 7 aa, synthetic construct
QSTTLKR

SEQ ID NO: 188 - protein, 7 aa, synthetic construct
RADNLRR

SEQ ID NO: 189 - protein, 7 aa, synthetic construct
RSHNLKL

SEQ ID NO: 190 - protein, 7 aa, synthetic construct
RSHNLRL

SEQ ID NO: 191 - protein, 7 aa, synthetic construct
QSTTLKR

SEQ ID NO: 192 - protein, 7 aa, synthetic construct
SDRRDLD

SEQ ID NO: 193 - protein, 7 aa, synthetic construct
QSAHLKR

SEQ ID NO: 194 - protein, 7 aa, synthetic construct
DLSTLRR

SEQ ID NO: 195 - protein, 7 aa, synthetic construct
DGSTLRR

SEQ ID NO: 196 - protein, 7 aa, synthetic construct
EKASLIK

SEQ ID NO: 197 - protein, 7 aa, synthetic construct
DKSSLRK

SEQ ID NO: 198 - protein, 7 aa, synthetic construct
CNGSLKK

SEQ ID NO: 199 - protein, 7 aa, synthetic construct
DHSSLKR

SEQ ID NO: 200 - protein, 7 aa, synthetic construct
RGDGLRR

SEQ ID NO: 201 - protein, 7 aa, synthetic construct
RKLGLLR

SEQ ID NO: 202 - protein, 7 aa, synthetic construct
GLTALRT

SEQ ID NO: 203 - protein, 7 aa, synthetic construct
QNANLKR

SEQ ID NO: 204 - protein, 7 aa, synthetic construct
LKSNLHR

SEQ ID NO: 205 - protein, 7 aa, synthetic construct
QRRYLVE

SEQ ID NO: 206 - protein, 7 aa, synthetic construct
TTFNLRV

SEQ ID NO: 207 - protein, 7 aa, synthetic construct
EEANLRR

SEQ ID NO: 208 - protein, 7 aa, synthetic construct
QRSSLVR

SEQ ID NO: 209 - protein, 7 aa, synthetic construct
QSSSLVR

SEQ ID NO: 210 - protein, 7 aa, synthetic construct
KRYNLYQ

SEQ ID NO: 211 - protein, 7 aa, synthetic construct
KKFNLLQ

SEQ ID NO: 212 - protein, 7 aa, synthetic construct
RNFILQR

SEQ ID NO: 213 - protein, 7 aa, synthetic construct
RNFILAR

SEQ ID NO: 214 - protein, 7 aa, synthetic construct
QREHLTT

SEQ ID NO: 215 - protein, 7 aa, synthetic construct
QREHLNG

SEQ ID NO: 216 - protein, 7 aa, synthetic construct
DPANLRR

SEQ ID NO: 217 - protein, 7 aa, synthetic construct
RRRNLTL

SEQ ID NO: 218 - protein, 7 aa, synthetic construct
RRRNLQL

SEQ ID NO: 219 - protein, 7 aa, synthetic construct
DKANLTR

SEQ ID NO: 220 - protein, 7 aa, synthetic construct
DSSNLRR

SEQ ID NO: 221 - protein, 7 aa, synthetic construct
EQGNLLR

SEQ ID NO: 222 - protein, 7 aa, synthetic construct
QSTTLKR

SEQ ID NO: 223 - protein, 7 aa, synthetic construct
RRDGLAG

SEQ ID NO: 224 - protein, 7 aa, synthetic construct
SFQSYLE

SEQ ID NO: 225 - protein, 7 aa, synthetic construct
ETGSLRR

SEQ ID NO: 226 - protein, 7 aa, synthetic construct
DRTPLNR

SEQ ID NO: 227 - protein, 7 aa, synthetic construct
QNEHLKV

SEQ ID NO: 228 - protein, 7 aa, synthetic construct
QKTHLAV

SEQ ID NO: 229 - protein, 7 aa, synthetic construct
DHSSLKR

SEQ ID NO: 230 - protein, 7 aa, synthetic construct
QPHGLAH

SEQ ID NO: 231 - protein, 7 aa, synthetic construct
QPHGLRH

SEQ ID NO: 232 - protein, 7 aa, synthetic construct
QPHGLST

SEQ ID NO: 233 - protein, 7 aa, synthetic construct
RRDNLNR

SEQ ID NO: 234 - protein, 7 aa, synthetic construct
RQDNLGR

SEQ ID NO: 235 - protein, 7 aa, synthetic construct
ERAKLIR

SEQ ID NO: 236 - protein, 7 aa, synthetic construct
QKHHLAV

SEQ ID NO: 237 - protein, 7 aa, synthetic construct
LKQHLVV

SEQ ID NO: 238 - protein, 7 aa, synthetic construct
QQTNLAR

SEQ ID NO: 239 - protein, 7 aa, synthetic construct
QTQNLTR

SEQ ID NO: 240 - protein, 7 aa, synthetic construct
RGEHLTR

SEQ ID NO: 241 - protein, 7 aa, synthetic construct
RREHLVR

SEQ ID NO: 242 - protein, 7 aa, synthetic construct
RKDALHV

SEQ ID NO: 243 - protein, 7 aa, synthetic construct
RKERLAT

SEQ ID NO: 244 - protein, 7 aa, synthetic construct
DPTSLNR

SEQ ID NO: 245 - protein, 7 aa, synthetic construct
RQDNLNT

SEQ ID NO: 246 - protein, 7 aa, synthetic construct
RRDNLKS

SEQ ID NO: 247 - protein, 7 aa, synthetic construct
RNDTLII

SEQ ID NO: 248 - protein, 7 aa, synthetic construct
RQDILVV

SEQ ID NO: 249 - protein, 7 aa, synthetic construct
RGDNLKR

SEQ ID NO: 250 - protein, 7 aa, synthetic construct
RGDNLAR

SEQ ID NO: 251 - protein, 7 aa, synthetic construct
RQEHLVR

SEQ ID NO: 252 - protein, 7 aa, synthetic construct
DRSSLKR

SEQ ID NO: 253 - protein, 7 aa, synthetic construct
AMRSLMG

SEQ ID NO: 254 - protein, 7 aa, synthetic construct
QQRSLVG

SEQ ID NO: 255 - protein, 7 aa, synthetic construct
DQGNLIR

SEQ ID NO: 256 - protein, 7 aa, synthetic construct
DGGNLGR

SEQ ID NO: 257 - protein, 7 aa, synthetic construct
RNTNLTR

SEQ ID NO: 258 - protein, 7 aa, synthetic construct
RQDNLGR

SEQ ID NO: 259 - protein, 7 aa, synthetic construct
VHHNLVR

SEQ ID NO: 260 - protein, 7 aa, synthetic construct
RPNHLAI

SEQ ID NO: 261 - protein, 7 aa, synthetic construct
QSHSLKS

SEQ ID NO: 262 - protein, 7 aa, synthetic construct
QKHHLVT

SEQ ID NO: 263 - protein, 7 aa, synthetic construct
GGTALRM

SEQ ID NO: 264 - protein, 7 aa, synthetic construct
GGSALSM

SEQ ID NO: 265 - protein, 7 aa, synthetic construct
RRFILSR

SEQ ID NO: 266 - protein, 7 aa, synthetic construct
RNFILQR

SEQ ID NO: 267 - protein, 7 aa, synthetic construct
QSAHLKR

SEQ ID NO: 268 - protein, 7 aa, synthetic construct
QQAHLVR

SEQ ID NO: 269 - protein, 7 aa, synthetic construct
RARNLTL

SEQ ID NO: 270 - protein, 7 aa, synthetic construct
RRRNLQL

SEQ ID NO: 271 - protein, 7 aa, synthetic construct
AKRDLDR

SEQ ID NO: 272 - protein, 7 aa, synthetic construct
LRKDLVR

SEQ ID NO: 273 - protein, 7 aa, synthetic construct
QRSNLAR

SEQ ID NO: 274 - protein, 7 aa, synthetic construct
LKTNLAR

SEQ ID NO: 275 - protein, 7 aa, synthetic construct
QRSDLTR

SEQ ID NO: 276 - protein, 7 aa, synthetic construct
HKETLNR

SEQ ID NO: 277 - protein, 7 aa, synthetic construct
TNSSLTR

SEQ ID NO: 278 - protein, 7 aa, synthetic construct
MTSSLRR

SEQ ID NO: 279 - protein, 7 aa, synthetic construct
VRHNLTR

SEQ ID NO: 280 - protein, 7 aa, synthetic construct
VAHNLTR

SEQ ID NO: 281 - protein, 7 aa, synthetic construct
QSSSLVR

SEQ ID NO: 282 - protein, 7 aa, synthetic construct
RSHNLKL

SEQ ID NO: 283 - protein, 7 aa, synthetic construct
RSHNLRL

SEQ ID NO: 284 - protein, 7 aa, synthetic construct
TSTLLKR

SEQ ID NO: 285 - protein, 7 aa, synthetic construct
HKSSLTR

SEQ ID NO: 286 - protein, 7 aa, synthetic construct
RRQKLTI

SEQ ID NO: 287 - protein, 7 aa, synthetic construct
MKHHLGR

SEQ ID NO: 288 - protein, 7 aa, synthetic construct
LKQHLVR

SEQ ID NO: 289 - protein, 7 aa, synthetic construct
QNEHLKV

SEQ ID NO: 290 - protein, 7 aa, synthetic construct
QKTHLAV

SEQ ID NO: 291 - protein, 7 aa, synthetic construct
QPHSLAV

SEQ ID NO: 292 - protein, 7 aa, synthetic construct
RRQHLQY

SEQ ID NO: 293 - protein, 7 aa, synthetic construct
RRSRLVR

SEQ ID NO: 294 - protein, 7 aa, synthetic construct
EAHHLSR

SEQ ID NO: 295 - protein, 7 aa, synthetic construct
RQSRLQR

SEQ ID NO: 296 - protein, 7 aa, synthetic construct
HRHVLIN

SEQ ID NO: 297 - protein, 7 aa, synthetic construct
IKHNLAR

SEQ ID NO: 298 - protein, 7 aa, synthetic construct
VVNNLNR

SEQ ID NO: 299 - protein, 7 aa, synthetic construct
ISHNLAR

SEQ ID NO: 300 - protein, 7 aa, synthetic construct
QSPHLKR

SEQ ID NO: 301 - protein, 7 aa, synthetic construct
ESGHLKR

SEQ ID NO: 302 - protein, 7 aa, synthetic construct
ENSKLRR

SEQ ID NO: 303 - protein, 7 aa, synthetic construct
QRSSLVR

SEQ ID NO: 304 - protein, 7 aa, synthetic construct
RNDSLKC

SEQ ID NO: 305 - protein, 7 aa, synthetic construct
RNDTLII

SEQ ID NO: 306 - protein, 7 aa, synthetic construct
VGNSLSR

SEQ ID NO: 307 - protein, 7 aa, synthetic construct
VHESLKR

SEQ ID NO: 308 - protein, 7 aa, synthetic construct
DPSSLKR

SEQ ID NO: 309 - protein, 7 aa, synthetic construct
DHSSLKR

SEQ ID NO: 310 - protein, 7 aa, synthetic construct
VNSSLTR

SEQ ID NO: 311 - protein, 7 aa, synthetic construct
VRHSLTR

SEQ ID NO: 312 - protein, 7 aa, synthetic construct
QKVHLEA

SEQ ID NO: 313 - protein, 7 aa, synthetic construct
QKCHLKA

SEQ ID NO: 314 - protein, 7 aa, synthetic construct
RGDNLNR

SEQ ID NO: 315 - protein, 7 aa, synthetic construct
REDNLGR

SEQ ID NO: 316 - protein, 7 aa, synthetic construct
RIDNLIR

SEQ ID NO: 317 - protein, 7 aa, synthetic construct
RQDNLGR

SEQ ID NO: 318 - protein, 7 aa, synthetic construct
QTNTLGR

SEQ ID NO: 319 - protein, 7 aa, synthetic construct
QGGTLRR

SEQ ID NO: 320 - protein, 7 aa, synthetic construct
QSTTLKR

SEQ ID NO: 321 - protein, 7 aa, synthetic construct
LKEHLTR

SEQ ID NO: 322 - protein, 7 aa, synthetic construct
HKSSLTR

SEQ ID NO: 323 - protein, 7 aa, synthetic construct
QNSHLRR

SEQ ID NO: 324 - protein, 7 aa, synthetic construct
QGGHLAR

SEQ ID NO: 325 - protein, 7 aa, synthetic construct
QGGHLKR

SEQ ID NO: 326 - protein, 7 aa, synthetic construct
QKPHLSR

SEQ ID NO: 327 - protein, 7 aa, synthetic construct
QSAHLKR

SEQ ID NO: 328 - protein, 7 aa, synthetic construct
RGEHLTR

SEQ ID NO: 329 - protein, 7 aa, synthetic construct
RTEHLAR

SEQ ID NO: 330 - protein, 7 aa, synthetic construct
RREHLVR

SEQ ID NO: 331 - protein, 7 aa, synthetic construct
TNSSLTR

SEQ ID NO: 332 - protein, 7 aa, synthetic construct
IRTSLKR

SEQ ID NO: 333 - DNA, 20 bp, Hepatitis B virus
  source 1..20: mol_type = genomic DNA
cctgctggtggctccagttc

SEQ ID NO: 334 - DNA, 20 bp, Hepatitis B virus
  source 1..20: mol_type = genomic DNA
ctgaactggagccaccagca

SEQ ID NO: 335 - DNA, 20 bp, Hepatitis B virus
  source 1..20: mol_type = genomic DNA
cctgaactggagccaccagc

SEQ ID NO: 336 - DNA, 20 bp, Hepatitis B virus
  source 1..20: mol_type = genomic DNA
cctcgagaagattgacgata

SEQ ID NO: 337 - DNA, 20 bp, Hepatitis B virus
  source 1..20: mol_type = genomic DNA
tcgtcaatcttctcgaggat

SEQ ID NO: 338 - DNA, 20 bp, Hepatitis B virus
  source 1..20: mol_type = genomic DNA
cgtcaatcttctcgaggatt

SEQ ID NO: 339 - DNA, 20 bp, Hepatitis B virus
  source 1..20: mol_type = genomic DNA
gtcaatcttctcgaggattg

SEQ ID NO: 340 - DNA, 20 bp, Hepatitis B virus
  source 1..20: mol_type = genomic DNA
aacatggagaacatcacatc

SEQ ID NO: 341 - DNA, 20 bp, Hepatitis B virus
  source 1..20: mol_type = genomic DNA
aacatcacatcaggattcct

SEQ ID NO: 342 - DNA, 20 bp, Hepatitis B virus
  source 1..20: mol_type = genomic DNA
ctagactctgcggtattgtg

SEQ ID NO: 343 - DNA, 20 bp, Hepatitis B virus
  source 1..20: mol_type = genomic DNA
taccgcagagtctagactcg

SEQ ID NO: 344 - DNA, 20 bp, Hepatitis B virus
  source 1..20: mol_type = genomic DNA
cgcagagtctagactcgtgg

SEQ ID NO: 345 - DNA, 20 bp, Hepatitis B virus
  source 1..20: mol_type = genomic DNA
caccacgagtctagactctg

SEQ ID NO: 346 - DNA, 20 bp, Hepatitis B virus
  source 1..20: mol_type = genomic DNA
tggacttctctcaattttct

SEQ ID NO: 347 - DNA, 20 bp, Hepatitis B virus
  source 1..20: mol_type = genomic DNA
ggacttctctcaattttcta

SEQ ID NO: 348 - DNA, 20 bp, Hepatitis B virus
  source 1..20: mol_type = genomic DNA
gacttctctcaattttctag

SEQ ID NO: 349 - DNA, 20 bp, Hepatitis B virus
  source 1..20: mol_type = genomic DNA
acttctctcaattttctagg

SEQ ID NO: 350 - DNA, 20 bp, Hepatitis B virus
  source 1..20: mol_type = genomic DNA
cgaattttggccaagacaca

SEQ ID NO: 351 - DNA, 20 bp, Hepatitis B virus
  source 1..20: mol_type = genomic DNA
aggttggggactgcgaattt

SEQ ID NO: 352 - DNA, 20 bp, Hepatitis B virus
  source 1..20: mol_type = genomic DNA
ggcatagcagcaggatgaag

SEQ ID NO: 353 - DNA, 20 bp, Hepatitis B virus
  source 1..20: mol_type = genomic DNA
agaagatgaggcatagcagc

SEQ ID NO: 354 - DNA, 20 bp, Hepatitis B virus
  source 1..20: mol_type = genomic DNA
gctatgcctcatcttcttgt

SEQ ID NO: 355 - DNA, 20 bp, Hepatitis B virus
  source 1..20: mol_type = genomic DNA
gaagaaccaacaagaagatg

SEQ ID NO: 356 - DNA, 20 bp, Hepatitis B virus
  source 1..20: mol_type = genomic DNA
catcttcttgttggttcttc

SEQ ID NO: 357 - DNA, 20 bp, Hepatitis B virus
  source 1..20: mol_type = genomic DNA
cccgtttgtcctctaattcc

SEQ ID NO: 358 - DNA, 20 bp, Hepatitis B virus
  source 1..20: mol_type = genomic DNA
cctggaattagaggacaaac

SEQ ID NO: 359 - DNA, 20 bp, Hepatitis B virus
  source 1..20: mol_type = genomic DNA
tcctggaattagaggacaaa

SEQ ID NO: 360 - DNA, 20 bp, Hepatitis B virus
  source 1..20: mol_type = genomic DNA
tactagtgccatttgttcag

SEQ ID NO: 361 - DNA, 20 bp, Hepatitis B virus
  source 1..20: mol_type = genomic DNA
ccatttgttcagtggttcgt

SEQ ID NO: 362 - DNA, 20 bp, Hepatitis B virus
  source 1..20: mol_type = genomic DNA
catttgttcagtggttcgta

SEQ ID NO: 363 - DNA, 20 bp, Hepatitis B virus
  source 1..20: mol_type = genomic DNA
cctacgaaccactgaacaaa

SEQ ID NO: 364 - DNA, 20 bp, Hepatitis B virus
  source 1..20: mol_type = genomic DNA
tttcagttatatggatgatg

SEQ ID NO: 365 - DNA, 20 bp, Hepatitis B virus
  source 1..20: mol_type = genomic DNA
caaaagaaaattggtaacag

SEQ ID NO: 366 - DNA, 20 bp, Hepatitis B virus
  source 1..20: mol_type = genomic DNA
taccaattttcttttgtctt

SEQ ID NO: 367 - DNA, 20 bp, Hepatitis B virus
  source 1..20: mol_type = genomic DNA
accaattttcttttgtcttt

SEQ ID NO: 368 - DNA, 20 bp, Hepatitis B virus
  source 1..20: mol_type = genomic DNA
acccaaagacaaaagaaaat

SEQ ID NO: 369 - DNA, 20 bp, Hepatitis B virus
  source 1..20: mol_type = genomic DNA
tgacatactttccaatcaat

SEQ ID NO: 370 - DNA, 20 bp, Hepatitis B virus
  source 1..20: mol_type = genomic DNA
cactttctcgccaacttaca

SEQ ID NO: 371 - DNA, 20 bp, Hepatitis B virus
  source 1..20: mol_type = genomic DNA
cacagaaaggccttgtaagt

SEQ ID NO: 372 - DNA, 20 bp, Hepatitis B virus
  source 1..20: mol_type = genomic DNA
tgaacctttaccccgttgcc

SEQ ID NO: 373 - DNA, 20 bp, Hepatitis B virus
  source 1..20: mol_type = genomic DNA
gggcaacggggtaaaggttc

SEQ ID NO: 374 - DNA, 20 bp, Hepatitis B virus
  source 1..20: mol_type = genomic DNA
tttaccccgttgcccggcaa

SEQ ID NO: 375 - DNA, 20 bp, Hepatitis B virus
  source 1..20: mol_type = genomic DNA
gttgccgggcaacggggtaa

SEQ ID NO: 376 - DNA, 20 bp, Hepatitis B virus
  source 1..20: mol_type = genomic DNA
cccgttgcccggcaacggcc

SEQ ID NO: 377 - DNA, 20 bp, Hepatitis B virus
  source 1..20: mol_type = genomic DNA
ctggccgttgccgggcaacg

SEQ ID NO: 378 - DNA, 20 bp, Hepatitis B virus
  source 1..20: mol_type = genomic DNA
cctggccgttgccgggcaac

SEQ ID NO: 379 - DNA, 20 bp, Hepatitis B virus
  source 1..20: mol_type = genomic DNA
acctggccgttgccgggcaa

SEQ ID NO: 380 - DNA, 20 bp, Hepatitis B virus
  source 1..20: mol_type = genomic DNA
gcacagacctggccgttgcc

SEQ ID NO: 381 - DNA, 20 bp, Hepatitis B virus
  source 1..20: mol_type = genomic DNA
ggcacagacctggccgttgc

SEQ ID NO: 382 - DNA, 20 bp, Hepatitis B virus
  source 1..20: mol_type = genomic DNA
gcaaacacttggcacagacc

SEQ ID NO: 383 - DNA, 20 bp, Hepatitis B virus
  source 1..20: mol_type = genomic DNA
gggttgcgtcagcaaacact

SEQ ID NO: 384 - DNA, 20 bp, Hepatitis B virus
  source 1..20: mol_type = genomic DNA
tttgctgacgcaacccccac

SEQ ID NO: 385 - DNA, 20 bp, Hepatitis B virus
  source 1..20: mol_type = genomic DNA
ctgacgcaacccccactggc

SEQ ID NO: 386 - DNA, 20 bp, Hepatitis B virus
  source 1..20: mol_type = genomic DNA
tgacgcaacccccactggct

SEQ ID NO: 387 - DNA, 20 bp, Hepatitis B virus
  source 1..20: mol_type = genomic DNA
gacgcaacccccactggctg

SEQ ID NO: 388 - DNA, 20 bp, Hepatitis B virus
  source 1..20: mol_type = genomic DNA
aacccccactggctggggct

SEQ ID NO: 389 - DNA, 20 bp, Hepatitis B virus
  source 1..20: mol_type = genomic DNA
tcctctgccgatccatactg

SEQ ID NO: 390 - DNA, 20 bp, Hepatitis B virus
  source 1..20: mol_type = genomic DNA
tccgcagtatggatcggcag

SEQ ID NO: 391 - DNA, 20 bp, Hepatitis B virus
  source 1..20: mol_type = genomic DNA
aggagttccgcagtatggat

SEQ ID NO: 392 - DNA, 20 bp, Hepatitis B virus
  source 1..20: mol_type = genomic DNA
cggctaggagttccgcagta

SEQ ID NO: 393 - DNA, 20 bp, Hepatitis B virus
  source 1..20: mol_type = genomic DNA
tgcgagcaaaacaagcggct

SEQ ID NO: 394 - DNA, 20 bp, Hepatitis B virus
  source 1..20: mol_type = genomic DNA
ccgcttgttttgctcgcagc

SEQ ID NO: 395 - DNA, 20 bp, Hepatitis B virus
  source 1..20: mol_type = genomic DNA
cctgctgcgagcaaaacaag

SEQ ID NO: 396 - DNA, 20 bp, Hepatitis B virus
  source 1..20: mol_type = genomic DNA
tgttttgctcgcagcaggtc

SEQ ID NO: 397 - DNA, 20 bp, Hepatitis B virus
  source 1..20: mol_type = genomic DNA
gcagcacagcctagcagcca

SEQ ID NO: 398 - DNA, 20 bp, Hepatitis B virus
  source 1..20: mol_type = genomic DNA
tgctaggctgtgctgccaac

SEQ ID NO: 399 - DNA, 20 bp, Hepatitis B virus
  source 1..20: mol_type = genomic DNA
gctgccaactggatcctgcg

SEQ ID NO: 400 - DNA, 20 bp, Hepatitis B virus
  source 1..20: mol_type = genomic DNA
ctgccaactggatcctgcgc

SEQ ID NO: 401 - DNA, 20 bp, Hepatitis B virus
  source 1..20: mol_type = genomic DNA
cgtcccgcgcaggatccagt

SEQ ID NO: 402 - DNA, 20 bp, Hepatitis B virus
  source 1..20: mol_type = genomic DNA
aaacaaaggacgtcccgcgc

SEQ ID NO: 403 - DNA, 20 bp, Hepatitis B virus
  source 1..20: mol_type = genomic DNA
gtcctttgtttacgtcccgt

SEQ ID NO: 404 - DNA, 20 bp, Hepatitis B virus
  source 1..20: mol_type = genomic DNA
cgccgacgggacgtaaacaa

SEQ ID NO: 405 - DNA, 20 bp, Hepatitis B virus
  source 1..20: mol_type = genomic DNA
tgccgttccgaccgaccacg

SEQ ID NO: 406 - DNA, 20 bp, Hepatitis B virus
  source 1..20: mol_type = genomic DNA
aggtgcgccccgtggtcggt

SEQ ID NO: 407 - DNA, 20 bp, Hepatitis B virus
  source 1..20: mol_type = genomic DNA
agagaggtgcgccccgtggt

SEQ ID NO: 408 - DNA, 20 bp, Hepatitis B virus
  source 1..20: mol_type = genomic DNA
gtaaagagaggtgcgccccg

SEQ ID NO: 409 - DNA, 20 bp, Hepatitis B virus
  source 1..20: mol_type = genomic DNA
ggggcgcacctctctttacg

SEQ ID NO: 410 - DNA, 20 bp, Hepatitis B virus
  source 1..20: mol_type = genomic DNA
cggggagtccgcgtaaagag

SEQ ID NO: 411 - DNA, 20 bp, Hepatitis B virus
  source 1..20: mol_type = genomic DNA
cagatgagaaggcacagacg

SEQ ID NO: 412 - DNA, 20 bp, Hepatitis B virus
  source 1..20: mol_type = genomic DNA
gtctgtgccttctcatctgc

SEQ ID NO: 413 - DNA, 20 bp, Hepatitis B virus
  source 1..20: mol_type = genomic DNA
ggcagatgagaaggcacaga

SEQ ID NO: 414 - DNA, 20 bp, Hepatitis B virus
  source 1..20: mol_type = genomic DNA
gcagatgagaaggcacagac

SEQ ID NO: 415 - DNA, 20 bp, Hepatitis B virus
  source 1..20: mol_type = genomic DNA
acacggtccggcagatgaga

SEQ ID NO: 416 - DNA, 20 bp, Hepatitis B virus
  source 1..20: mol_type = genomic DNA
gaagcgaagtgcacacggtc

SEQ ID NO: 417 - DNA, 20 bp, Hepatitis B virus
  source 1..20: mol_type = genomic DNA
gaggtgaagcgaagtgcaca

SEQ ID NO: 418 - DNA, 20 bp, Hepatitis B virus
  source 1..20: mol_type = genomic DNA
cttcacctctgcacgtcgca

SEQ ID NO: 419 - DNA, 20 bp, Hepatitis B virus
  source 1..20: mol_type = genomic DNA
ggtctccatgcgacgtgcag

SEQ ID NO: 420 - DNA, 20 bp, Hepatitis B virus
  source 1..20: mol_type = genomic DNA
tgcccaaggtcttacataag

SEQ ID NO: 421 - DNA, 20 bp, Hepatitis B virus
  source 1..20: mol_type = genomic DNA
gtcctcttatgtaagacctt

SEQ ID NO: 422 - DNA, 20 bp, Hepatitis B virus
  source 1..20: mol_type = genomic DNA
agtcctcttatgtaagacct

SEQ ID NO: 423 - DNA, 20 bp, Hepatitis B virus
  source 1..20: mol_type = genomic DNA
gtcttacataagaggactct

SEQ ID NO: 424 - DNA, 20 bp, Hepatitis B virus
  source 1..20: mol_type = genomic DNA
aatgtcaacgaccgaccttg

SEQ ID NO: 425 - DNA, 20 bp, Hepatitis B virus
  source 1..20: mol_type = genomic DNA
tttgaagtatgcctcaaggt

SEQ ID NO: 426 - DNA, 20 bp, Hepatitis B virus
  source 1..20: mol_type = genomic DNA
agtctttgaagtatgcctca

SEQ ID NO: 427 - DNA, 20 bp, Hepatitis B virus
  source 1..20: mol_type = genomic DNA
aagactgtttgtttaaagac

SEQ ID NO: 428 - DNA, 20 bp, Hepatitis B virus
  source 1..20: mol_type = genomic DNA
agactgtttgtttaaagact

SEQ ID NO: 429 - DNA, 20 bp, Hepatitis B virus
  source 1..20: mol_type = genomic DNA
ctgtttgtttaaagactggg

SEQ ID NO: 430 - DNA, 20 bp, Hepatitis B virus
  source 1..20: mol_type = genomic DNA
gtttaaagactgggaggagt

SEQ ID NO: 431 - DNA, 20 bp, Hepatitis B virus
  source 1..20: mol_type = genomic DNA
tctttgtactaggaggctgt

SEQ ID NO: 432 - DNA, 20 bp, Hepatitis B virus
  source 1..20: mol_type = genomic DNA
aggaggctgtaggcataaat

SEQ ID NO: 433 - DNA, 20 bp, Hepatitis B virus
  source 1..20: mol_type = genomic DNA
gtgaaaaagttgcatggtgc

SEQ ID NO: 434 - DNA, 20 bp, Hepatitis B virus
  source 1..20: mol_type = genomic DNA
gcagaggtgaaaaagttgca

SEQ ID NO: 435 - DNA, 20 bp, Hepatitis B virus
  source 1..20: mol_type = genomic DNA
aacaagagatgattaggcag

SEQ ID NO: 436 - DNA, 20 bp, Hepatitis B virus
  source 1..20: mol_type = genomic DNA
gacatgaacaagagatgatt

SEQ ID NO: 437 - DNA, 20 bp, Hepatitis B virus
  source 1..20: mol_type = genomic DNA
agcttggaggcttgaacagt

SEQ ID NO: 438 - DNA, 20 bp, Hepatitis B virus
  source 1..20: mol_type = genomic DNA
caagcctccaagctgtgcct

SEQ ID NO: 439 - DNA, 20 bp, Hepatitis B virus
  source 1..20: mol_type = genomic DNA
aagcctccaagctgtgcctt

SEQ ID NO: 440 - DNA, 20 bp, Hepatitis B virus
  source 1..20: mol_type = genomic DNA
cctccaagctgtgccttggg

SEQ ID NO: 441 - DNA, 20 bp, Hepatitis B virus
  source 1..20: mol_type = genomic DNA
ccacccaaggcacagcttgg

SEQ ID NO: 442 - DNA, 20 bp, Hepatitis B virus
  source 1..20: mol_type = genomic DNA
agctgtgccttgggtggctt

SEQ ID NO: 443 - DNA, 20 bp, Hepatitis B virus
  source 1..20: mol_type = genomic DNA
aagccacccaaggcacagct

SEQ ID NO: 444 - DNA, 20 bp, Hepatitis B virus
  source 1..20: mol_type = genomic DNA
gctgtgccttgggtggcttt

SEQ ID NO: 445 - DNA, 20 bp, Hepatitis B virus
  source 1..20: mol_type = genomic DNA
ctgtgccttgggtggctttg

SEQ ID NO: 446 - DNA, 20 bp, Hepatitis B virus
  source 1..20: mol_type = genomic DNA
tagctccaaattctttataa

SEQ ID NO: 447 - DNA, 20 bp, Hepatitis B virus
  source 1..20: mol_type = genomic DNA
gtagctccaaattctttata

SEQ ID NO: 448 - DNA, 20 bp, Hepatitis B virus
  source 1..20: mol_type = genomic DNA
taaagaatttggagctactg

SEQ ID NO: 449 - DNA, 20 bp, Hepatitis B virus
  source 1..20: mol_type = genomic DNA
atgactctagctacctgggt

SEQ ID NO: 450 - DNA, 20 bp, Hepatitis B virus
  source 1..20: mol_type = genomic DNA
cacatttcttgtctcacttt

SEQ ID NO: 451 - DNA, 20 bp, Hepatitis B virus
  source 1..20: mol_type = genomic DNA
tagtttccggaagtgttgat

SEQ ID NO: 452 - DNA, 20 bp, Hepatitis B virus
  source 1..20: mol_type = genomic DNA
cgtctaacaacagtagtttc

SEQ ID NO: 453 - DNA, 20 bp, Hepatitis B virus
  source 1..20: mol_type = genomic DNA
actactgttgttagacgacg

SEQ ID NO: 454 - DNA, 20 bp, Hepatitis B virus
  source 1..20: mol_type = genomic DNA
ctgttgttagacgacgaggc

SEQ ID NO: 455 - DNA, 20 bp, Hepatitis B virus
  source 1..20: mol_type = genomic DNA
cgagggagttcttcttctag

SEQ ID NO: 456 - DNA, 20 bp, Hepatitis B virus
  source 1..20: mol_type = genomic DNA
gcgagggagttcttcttcta

SEQ ID NO: 457 - DNA, 20 bp, Hepatitis B virus
  source 1..20: mol_type = genomic DNA
ggcgagggagttcttcttct

SEQ ID NO: 458 - DNA, 20 bp, Hepatitis B virus
  source 1..20: mol_type = genomic DNA
ctccctcgcctcgcagacga

SEQ ID NO: 459 - DNA, 20 bp, Hepatitis B virus
  source 1..20: mol_type = genomic DNA
gaccttcgtctgcgaggcga

SEQ ID NO: 460 - DNA, 20 bp, Hepatitis B virus
  source 1..20: mol_type = genomic DNA
agaccttcgtctgcgaggcg

SEQ ID NO: 461 - DNA, 20 bp, Hepatitis B virus
  source 1..20: mol_type = genomic DNA
gattgagaccttcgtctgcg

SEQ ID NO: 462 - DNA, 20 bp, Hepatitis B virus
  source 1..20: mol_type = genomic DNA
gattgagatcttctgcgacg

SEQ ID NO: 463 - DNA, 20 bp, Hepatitis B virus
  source 1..20: mol_type = genomic DNA
gtcgcagaagatctcaatct

SEQ ID NO: 464 - DNA, 20 bp, Hepatitis B virus
  source 1..20: mol_type = genomic DNA
tcgcagaagatctcaatctc

SEQ ID NO: 465 - DNA, 20 bp, Hepatitis B virus
  source 1..20: mol_type = genomic DNA
atatggtgacccacaaaatg

SEQ ID NO: 466 - DNA, 20 bp, Hepatitis B virus
  source 1..20: mol_type = genomic DNA
tttgtgggtcaccatattct

SEQ ID NO: 467 - DNA, 20 bp, Hepatitis B virus
  source 1..20: mol_type = genomic DNA
ttgtgggtcaccatattctt

SEQ ID NO: 468 - DNA, 20 bp, Hepatitis B virus
  source 1..20: mol_type = genomic DNA
gctggatccaactggtggtc

SEQ ID NO: 469 - DNA, 20 bp, Hepatitis B virus
  source 1..20: mol_type = genomic DNA
caccccaaaaggcctccgtg

SEQ ID NO: 470 - DNA, 20 bp, Hepatitis B virus
  source 1..20: mol_type = genomic DNA
ccttttggggtggagccctc

SEQ ID NO: 471 - DNA, 20 bp, Hepatitis B virus
  source 1..20: mol_type = genomic DNA
cctgagggctccaccccaaa

SEQ ID NO: 472 - DNA, 20 bp, Hepatitis B virus
  source 1..20: mol_type = genomic DNA
ggggtggagccctcaggctc

SEQ ID NO: 473 - DNA, 20 bp, Hepatitis B virus
  source 1..20: mol_type = genomic DNA
gggtggagccctcaggctca

SEQ ID NO: 474 - DNA, 20 bp, Hepatitis B virus
  source 1..20: mol_type = genomic DNA
cgattggtggaggcaggagg

SEQ ID NO: 475 - DNA, 20 bp, Hepatitis B virus
  source 1..20: mol_type = genomic DNA
ctcatcctcaggccatgcag

SEQ ID NO: 476 - protein, 1521 aa, synthetic construct
MYPYDVPDYASPKKKRKVEASDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSGGGALSPQHSAVTQGSIIKNKEGMDAKSLTAWSRTLVTFKDVFVDFTREEWKLLDTAQQIVYRNVMLENYKNLVSLGYQLTKPDVILRLEKGEEPWLVEREIHQETHPDSETAFEIKSSV

SEQ ID NO: 477 - protein, 1726 aa, synthetic construct
MYPYDVPDYASPKKKRKVEASDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSGGGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 478 - protein, 1790 aa, synthetic construct
MYPYDVPDYASPKKKRKVEASDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSGGGMAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 479 - protein, 9 aa, synthetic construct
YPYDVPDYA

SEQ ID NO: 480 - protein, 5 aa, synthetic construct
GSGGG

SEQ ID NO: 481 - protein, 2315 aa, synthetic construct
MPKKKRKVPKKKRKVYNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSELEDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSSGSETPGTSESATPESTGDSVAFEDVAVNFTLEEWALLDPSQKNLYRDVMRETFRNLASVGKQWEDQNIEDPFKIPRRNISHIPERLCESKEGGQGEESADYKDDDDKAPKKKRKVPKKKRKV

SEQ ID NO: 482 - DNA, 6948 bp, synthetic construct
  source 1..6948: mol_type = other DNA
atgccaaaaaagaagagaaaggtaccgaagaaaaaaagaaaggtatacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtgactccgttgctttcgaggacgtggccgtgaacttcacacttgaggaatgggccttgctcgacccaagtcagaagaatctgtacagagacgtgatgcgggagacattcaggaatctcgccagtgtcggaaagcagtgggaagaccagaacatcgaagatcctttcaagataccacggcgcaatatctcccacattcctgagaggctgtgtgaatctaaggaaggcggacaaggtgaggaaagcgctgattacaaagatgatgacgataaagcccccaagaagaaaaggaaggtcccaaagaaaaaaagaaaggtgtga

SEQ ID NO: 483 - protein, 2335 aa, synthetic construct
MPKKKRKVPKKKRKVYNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSELEDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSSGSETPGTSESATPESTGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLSADYKDDDDKAPKKKRKVPKKKRKV

SEQ ID NO: 484 - DNA, 7008 bp, synthetic construct
  source 1..7008: mol_type = other DNA
atgccaaaaaagaagagaaaggtaccgaagaaaaaaagaaaggtatacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctgattacaaagatgatgacgataaagcccccaagaagaaaaggaaggtcccaaagaaaaaaagaaaggtgtga

SEQ ID NO: 485 - protein, 150 aa, synthetic construct
  VARIANT 6..150: note = GGGGS repeats may be deleted
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 486 - skipped

SEQ ID NO: 487 - protein, 150 aa, synthetic construct
  VARIANT 6..150: note = EAAAK repeats may be deleted
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 488 - protein, 120 aa, synthetic construct
  VARIANT 5..120: note = SGGS repeats may be deleted
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 489 - protein, 60 aa, synthetic construct
  VARIANT 3..60: note = XP repeats may be deleted, wherein X is any amino acid
XPXPXPXPXPXPXPXPXPXPXPXPXPXPXPXPXPXPXPXPXPXPXPXPXPXPXPXPXPXP

SEQ ID NO: 490 - protein, 21 aa, synthetic construct
  VARIANT 4..21: note = 4 or 6 GGS repeats may be deleted
GGSGGSGGSGGSGGSGGSGGS

SEQ ID NO: 491 - protein, 20 aa, synthetic construct
GGGGSGGGGSGGGGSGGGGS

SEQ ID NO: 492 - protein, 2326 aa, synthetic construct
MPKKKRKVPKKKRKVYNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSELEDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSSGSETPGTSESATPESTGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLSAPKKKRKVPKKKRKV

SEQ ID NO: 493 - DNA, 10942 bp, synthetic construct
  source 1..10942: mol_type = other DNA
gggcgctcgagcaggttcagaaggagatcaaaaacccccaaggatcaaacatgccaaaaaagaagagaaaggtaccgaagaaaaaaagaaaggtatacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctcccaagaagaaaaggaaggtcccaaagaaaaaaagaaaggtgtgaggatcctgagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcttgaagagcctagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataag

SEQ ID NO: 494 - DNA, 6981 bp, synthetic construct
  source 1..6981: mol_type = other DNA
atgccaaaaaagaagagaaaggtaccgaagaaaaaaagaaaggtatacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctcccaagaagaaaaggaaggtcccaaagaaaaaaagaaaggtgtga

SEQ ID NO: 495 - protein, 100 aa, synthetic construct
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESL

SEQ ID NO: 496 - protein, 106 aa, synthetic construct
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQW

SEQ ID NO: 497 - protein, 95 aa, synthetic construct
MLENYRNLVFLGIAVSKPDLITCLEQGKEPCNMKRHEMVAKPPVMCSHIAEDLCPERDIKYFFQKVILRRYDKCEHENLQLRKGCKSVDECKVCK

SEQ ID NO: 498 - protein, 95 aa, synthetic construct
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSF

SEQ ID NO: 499 - protein, 116 aa, synthetic construct
MLQMQNSEHHGQSIKTQTDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTG

SEQ ID NO: 500 - protein, 100 aa, synthetic construct
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQ

SEQ ID NO: 501 - protein, 98 aa, synthetic construct
MAQGLVTFADVAIDFSQEEWACLNSAQRDLYWDVMLENYSNLVSLDLESAYENKSLPTKKNIHEIRASKRNSDRRSKSLGRNWICEGTLERPQRSRGR

SEQ ID NO: 502 - protein, 118 aa, synthetic construct
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFEFQWQ

SEQ ID NO: 503 - protein, 104 aa, synthetic construct
MPGPPGSLEMGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSF

SEQ ID NO: 504 - protein, 113 aa, synthetic construct
MSPPWSPALAAEGRGSSCEASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHC

SEQ ID NO: 505 - protein, 109 aa, synthetic construct
MASPSPPPESKEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESL

SEQ ID NO: 506 - protein, 99 aa, synthetic construct
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSN

SEQ ID NO: 507 - protein, 100 aa, synthetic construct
MAASAQVSVTFEDVAVTFTQEEWGQLDAAQRTLYQEVMLETCGLLMSLGCPLFKPELIYQLDHRQELWMATKDLSQSSYPGDNTKPKTTEPTFSHLALPE

SEQ ID NO: 508 - protein, 144 aa, synthetic construct
MFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQE

SEQ ID NO: 509 - protein, 97 aa, synthetic construct
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDD

SEQ ID NO: 510 - protein, 112 aa, synthetic construct
MEEAQKRKAKESGMALPQGRLTFMDVAIEFSQEEWKSLDPGQRALYRDVMLENYRNLVFLGRSCVLGSNAENKPIKNQLGLTLESHLSELQLFQAGRKIYRSNQVEKFTNHR

SEQ ID NO: 511 - protein, 105 aa, synthetic construct
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSE

SEQ ID NO: 512 - protein, 99 aa, synthetic construct
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNR

SEQ ID NO: 513 - protein, 112 aa, synthetic construct
MEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEE

SEQ ID NO: 514 - protein, 97 aa, synthetic construct
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEV

SEQ ID NO: 515 - protein, 105 aa, synthetic construct
MAHKYVGLQYHGSVTFEDVAIAFSQQEWESLDSSQRGLYRDVMLENYRNLVSMAGHSRSKPHVIALLEQWKEPEVTVRKDGRRWCTDLQLEDDTIGCKEMPTSEN

SEQ ID NO: 516 - protein, 92 aa, synthetic construct
MAFEDVAVYFSQEEWGLLDTAQRALYRRVMLDNFALVASLGLSTSRPRVVIQLERGEEPWVPSGTDTTLSRTTYRRRNPGSWSLTEDRDVSG

SEQ ID NO: 517 - protein, 104 aa, synthetic construct
MLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQC

SEQ ID NO: 518 - protein, 127 aa, synthetic construct
MHFRRPDPCREPLASPIQDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGK

SEQ ID NO: 519 - protein, 110 aa, synthetic construct
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLW

SEQ ID NO: 520 - protein, 98 aa, synthetic construct
MTFEDIIVDFTQEEWALLDTSQRKLFQDVMLENISHLVSIGKQLCKSVVLSQLEQVEKLSTQRISLLQGREVGIKHQEIPFIHHIYQKGTSTISTMRS

SEQ ID NO: 521 - protein, 103 aa, synthetic construct
MAVTFEDVTIIFTWEEWKFLDSSQKRLYREVMWENYTNVMSVENWNESYKSQEEKFRYLEYENFSYWQGWWNAGAQMYENQNYGETVQGTDSKDLTQQDRSQC

SEQ ID NO: 522 - protein, 99 aa, synthetic construct
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKG

SEQ ID NO: 523 - protein, 114 aa, synthetic construct
MFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHIS

SEQ ID NO: 524 - protein, 112 aa, synthetic construct
METYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQ

SEQ ID NO: 525 - protein, 102 aa, synthetic construct
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRL

SEQ ID NO: 526 - protein, 62 aa, synthetic construct
MLDNYRNLVFLGIAVSKPDLITCLEQGKEPCNMKRHAMVAKPPVVCSHFAQDLWPKQGLKDS

SEQ ID NO: 527 - protein, 105 aa, synthetic construct
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQ

SEQ ID NO: 528 - protein, 97 aa, synthetic construct
MALRSVMFSDVSIDFSPEEWEYLDLEQKDLYRDVMLENYSNLVSLGCFISKPDVISSLEQGKEPWKVVRKGRRQYPDLETKYETKKLSLENDIYEIN

SEQ ID NO: 529 - protein, 98 aa, synthetic construct
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEW

SEQ ID NO: 530 - protein, 103 aa, synthetic construct
MFQVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHL

SEQ ID NO: 531 - protein, 98 aa, synthetic construct
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLP

SEQ ID NO: 532 - protein, 112 aa, synthetic construct
MSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQ

SEQ ID NO: 533 - protein, 95 aa, synthetic construct
MELVTFRDVAIEFSPEEWKCLDPAQQNLYRDVMLENYRNLVSLGFVISNPDLVTCLEQIKEPCNLKIHETAAKPPAICSPFSQDLSPVQGIEDSF

SEQ ID NO: 534 - protein, 112 aa, synthetic construct
MSTLLQGGHNLLSSASFQESVTFKDVIVDFTQEEWKQLDPGQRDLFRDVTLENYTHLVSIGLQVSKPDVISQLEQGTEPWIMEPSIPVGTCADWETRLENSVSAPEPDISEE

SEQ ID NO: 535 - protein, 112 aa, synthetic construct
MDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVG

SEQ ID NO: 536 - protein, 112 aa, synthetic construct
MKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEG

SEQ ID NO: 537 - protein, 108 aa, synthetic construct
MSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAE

SEQ ID NO: 538 - protein, 113 aa, synthetic construct
MLALAASQPARLEERLIRDRDLGASLLPAAPQEQWRQLDSTQKEQYWDLILETYGKMVSGAGISHPKSDLTNSIEFGEELAGIYLHVNEKIPRPTCIGDRQENDKENLNLENH

SEQ ID NO: 539 - protein, 131 aa, synthetic construct
MEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLA

SEQ ID NO: 540 - protein, 116 aa, synthetic construct
MVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDP

SEQ ID NO: 541 - protein, 113 aa, synthetic construct
MNKSQGSVSFTDVTVDFTQEEWEQLDPSQRILYMDVMLENYSNLLSVEVWKADDQMERDHRNPDEQARQFLILKNQTPIEERGDLFGKALNLNTDFVSLRQVPYKYDLYEKTL

SEQ ID NO: 542 - protein, 108 aa, synthetic construct
MAHGSVTFRDVAIDFSQEEWEFLDPAQRDLYRDVMWENYSNFISLGPSISKPDVITLLDEERKEPGMVVREGTRRYCPDLESRYRTNTLSPEKDIYEIYSFQWDIMER

SEQ ID NO: 543 - protein, 141 aa, synthetic construct
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQK

SEQ ID NO: 544 - protein, 133 aa, synthetic construct
MLPPTAASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMER

SEQ ID NO: 545 - protein, 107 aa, synthetic construct
MAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEK

SEQ ID NO: 546 - protein, 114 aa, synthetic construct
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYAR

SEQ ID NO: 547 - protein, 95 aa, synthetic construct
MAGSQFPDFKHLGTFLVFEELVTFEDVLVDFSPEELSSLSAAQRNLYREVMLENYRNLVSLGHQFSKPDIISRLEEEESYAMETDSRHTVICQGE

SEQ ID NO: 548 - protein, 78 aa, synthetic construct
MPGPPRSLEMGLLTFRDVAIEFSLEEWQHLDIAQQNLYRNVMLENYRNLAFLGIAVSKPDLITCLEQGKEPWNMKRHE

SEQ ID NO: 549 - protein, 93 aa, synthetic construct
MAPPLAPLPPRDPNGAGPEWREPGAVSFADVAVYFCREEWGCLRPAQRALYRDVMRETYGHLSALGIGGNKPALISWVEEEAELWGPAAQDPE

SEQ ID NO: 550 - protein, 100 aa, synthetic construct
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGESS

SEQ ID NO: 551 - protein, 573 aa, synthetic construct
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 552 - protein, 191 aa, synthetic construct
MGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 553 - protein, 228 aa, synthetic construct
MTMGDKKSPTRPKRQAKPAADEGFWDCSVCTFRNSAEAFKCSICDVRKGTSTRKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 554 - protein, 180 aa, synthetic construct
MGDKKSPTRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 555 - protein, 3065 aa, synthetic construct
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 556 - protein, 185 aa, synthetic construct
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 557 - protein, 660 aa, synthetic construct
MLVCYSVLACEILWDLPCSIMGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 558 - protein, 860 aa, synthetic construct
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 559 - protein, 103 aa, synthetic construct
MSEEKPKEGVKTENDHINLKVAGQDGSVVQFKIKRHTPLSKLMKAYCERQGLSMRQIRFRFDGQPINETDTPAQLEMEDEDTIDVFQQQTGGVPESSLAGHSF

SEQ ID NO: 560 - protein, 4834 aa, synthetic construct
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNAGLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESTDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 561 - protein, 593 aa, synthetic construct
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 562 - protein, 344 aa, synthetic construct
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 563 - protein, 526 aa, synthetic construct
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 564 - protein, 472 aa, synthetic construct
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 565 - protein, 457 aa, synthetic construct
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 566 - protein, 584 aa, synthetic construct
MASVQASRRQWCYLCDLPKMPWAMVWDFSEAVCRGCVNFEGADRIELLIDAARQLKRSHVLPEGRSPGPPALKHPATKDLAAAAAQGPQLPPPQAQPQPSGTGGGVSGQDRYDRATSSGRLPLPSPALEYTLGSRLANGLGREEAVAEGARRALLGSMPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 567 - protein, 587 aa, synthetic construct
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 568 - protein, 796 aa, synthetic construct
MSAAQVSSSRRQSCYLCDLPRMPWAMIWDFSEPVCRGCVNYEGADRIEFVIETARQLKRAHGCFQDGRSPGPPPPVGVKTVALSAKEAAAAAAAAAAAAAAAQQQQQQQQQQQQQQQQQQQQQQQQQLNHVDGSSKPAVLAAPSGLERYGLSAAAAAAAAAAAAVEQRSRFEYPPPPVSLGSSSHTARLPNGLGGPNGFPKPTPEEGPPELNRQSPNSSSAAASVASRRGTHGGLVTGLPNPGGGGGPQLTVPPNLLPQTLLNGPASAAVLPPPPPHALGSRGPPTPAPPGAPGGPACLGGTPGVSATSSSASSSTSSSVAEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 569 - protein, 388 aa, synthetic construct
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 570 - protein, 284 aa, synthetic construct
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 571 - protein, 330 aa, synthetic construct
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 572 - protein, 313 aa, synthetic construct
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 573 - protein, 304 aa, synthetic construct
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 574 - protein, 342 aa, synthetic construct
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 575 - protein, 410 aa, synthetic construct
MSARKGYLLPSPNYPTTMSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 576 - protein, 250 aa, synthetic construct
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 577 - protein, 272 aa, synthetic construct
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 578 - protein, 80 aa, synthetic construct
NKKLEAVGTGIEPKAMSQGLVTFGDVAVDFSQEEWEWLNPIQRNLYRKVMLENYRNLASLGLCVSKPDVISSLEQGKEPW

SEQ ID NO: 579 - protein, 80 aa, synthetic construct
KMKKFQIPVSFQDLTVNFTQEEWQQLDPAQRLLYRDVMLENYSNLVSVGYHVSKPDVIFKLEQGEEPWIVEEFSNQNYPD

SEQ ID NO: 580 - protein, 80 aa, synthetic construct
CSQESALSEEEEDTTRPLETVTFKDVAVDLTQEEWEQMKPAQRNLYRDVMLENYSNLVTVGCQVTKPDVIFKLEQEEEPW

SEQ ID NO: 581 - protein, 80 aa, synthetic construct
ITSQGSVSFRDVTVGFTQEEWQHLDPAQRTLYRDVMLENYSHLVSVGYCIPKPEVILKLEKGEEPWILEEKFPSQSHLEL

SEQ ID NO: 582 - protein, 80 aa, synthetic construct
PQVTFNDVAIDFTHEEWGWLSSAQRDLYKDVMVQNYENLVSVAGLSVTKPYVITLLEDGKEPWMMEKKLSKGMIPDWESR

SEQ ID NO: 583 - protein, 80 aa, synthetic construct
PLRFSTLFQEQQKMNISQASVSFKDVTIEFTQEEWQQMAPVQKNLYRDVMLENYSNLVSVGYCCFKPEVIFKLEQGEEPW

SEQ ID NO: 584 - protein, 80 aa, synthetic construct
QDPSAEGLSEEVPVVFEELPVVFEDVAVYFTREEWGMLDKRQKELYRDVMRMNYELLASLGPAAAKPDLISKLERRAAPW

SEQ ID NO: 585 - protein, 80 aa, synthetic construct
SQGSVTFRDVAIDFSQEEWKWLQPAQRDLYRCVMLENYGHLVSLGLSISKPDVVSLLEQGKEPWLGKREVKRDLFSVSES

SEQ ID NO: 586 - protein, 80 aa, synthetic construct
GSLTFRDVAIEFSLEEWQCLDTAQQNLYRNVMLENYRNLVFLGIAAFKPDLIIFLEEGKESWNMKRHEMVEESPVICSHF

SEQ ID NO: 587 - protein, 80 aa, synthetic construct
NKSQEQVSFKDVCVDFTQEEWYLLDPAQKILYRDVILENYSNLVSVGYCITKPEVIFKIEQGEEPWILEKGFPSQCHPER

SEQ ID NO: 588 - protein, 80 aa, synthetic construct
PHLLVTFRDVAIDFSQEEWECLDPAQRDLYRDVMLENYSNLISLDLESSCVTKKLSPEKEIYEMESLQWENMGKRINHHL

SEQ ID NO: 589 - protein, 80 aa, synthetic construct
EEERKTAELQKNRIQDSVVFEDVAVDFTQEEWALLDLAQRNLYRDVMLENFQNLASLGYPLHTPHLISQWEQEEDLQTVK

SEQ ID NO: 590 - protein, 80 aa, synthetic construct
GLLTFRDVAIEFSLEEWQCLDTAQKNLYRNVMLENYRNLAFLGIAVSKPDLIICLEKEKEPWNMKRDEMVDEPPGICPHF

SEQ ID NO: 591 - protein, 80 aa, synthetic construct
RAPTQVTVSPETHMDLTKGCVTFEDIAIYFSQDEWGLLDEAQRLLYLEVMLENFALVASLGCGHGTEDEETPSDQNVSVG

SEQ ID NO: 592 - protein, 80 aa, synthetic construct
AAVSPTTRCQESVTFEDVAVVFTDEEWSRLVPIQRDLYKEVMLENYNSIVSLGLPVPQPDVIFQLKRGDKPWMVDLHGSE

SEQ ID NO: 593 - protein, 80 aa, synthetic construct
HSLEKVTFEDVAIDFTQEEWDMMDTSKRKLYRDVMLENISHLVSLGYQISKSYIILQLEQGKELWREGRVFLQDQNPDRE

SEQ ID NO: 594 - protein, 80 aa, synthetic construct
DSVSFEDVAVNFTLEEWALLDSSQKKLYEDVMQETFKNLVCLGKKWEDQDIEDDHRNQGKNRRCHMVERLCESRRGSKCG

SEQ ID NO: 595 - protein, 80 aa, synthetic construct
NVEVVKVMPQDLVTFKDVAIDFSQEEWQWMNPAQKRLYRSMMLENYQSLVSLGLCISKPYVISLLEQGREPWEMTSEMTR

SEQ ID NO: 596 - protein, 80 aa, synthetic construct
TQPDEDLHLQAEETQLVKESVTFKDVAIDFTLEEWRLMDPTQRNLHKDVMLENYRNLVSLGLAVSKPDMISHLENGKGPW

SEQ ID NO: 597 - protein, 80 aa, synthetic construct
TMLQESFSFDDLSVDFTQKEWQLLDPSQKNLYKDVMLENYSSLVSLGYEVMKPDVIFKLEQGEEPWVGDGEIPSSDSPEV

SEQ ID NO: 598 - protein, 80 aa, synthetic construct
EVVTFGDVAVHFSREEWQCLDPGQRALYREVMLENHSSVAGLAGFLVFKPELISRLEQGEEPWVLDLQGAEGTEAPRTSK

SEQ ID NO: 599 - protein, 80 aa, synthetic construct
RNAEEERMIAVFLTTWLQEPMTFKDVAVEFTQEEWMMLDSAQRSLYRDVMLENYRNLTSVEYQLYRLTVISPLDQEEIRN

SEQ ID NO: 600 - protein, 80 aa, synthetic construct
GPQGARRQAFLAFGDVTVDFTQKEWRLLSPAQRALYREVTLENYSHLVSLGILHSKPELIRRLEQGEVPWGEERRRRPGP

SEQ ID NO: 601 - protein, 80 aa, synthetic construct
HSLKKLTFEDVAIDFTQEEWAMMDTSKRKLYRDVMLENISHLVSLGYQISKSYIILQLEQGKELWREGRVFLQDQNPNRE

SEQ ID NO: 602 - protein, 80 aa, synthetic construct
MPEVEFPDQFFTVLTMDHELVTLRDVVINFSQEEWEYLDSAQRNLYWDVMMENYSNLLSLDLESRNETKHLSVGKDIIQN

SEQ ID NO: 603 - protein, 80 aa, synthetic construct
PGAPGSLEMGPLTFRDVTIEFSLEEWQCLDTVQQNLYRDVMLENYRNLVFLGMAVFKPDLITCLKQGKEPWNMKRHEMVT

SEQ ID NO: 604 - protein, 80 aa, synthetic construct
RDPAQVPVAADLLTDHEEGYVTFEDVAVYFSQEEWRLLDDAQRLLYRNVMLENFTLLASLGLASSKTHEITQLESWEEPF

SEQ ID NO: 605 - protein, 80 aa, synthetic construct
HSLKKVTFEDVAIDFTQEEWAMMDTSKRKLYRDVMLENISHLVSLGYQISKSYIILQLEQGKELWREGREFLQDQNPDRE

SEQ ID NO: 606 - protein, 80 aa, synthetic construct
TKSKEAVTFKDVAVVFSEEELQLLDLAQRKLYRDVMLENFRNVVSVGHQSTPDGLPQLEREEKLWMMKMATQRDNSSGAK

SEQ ID NO: 607 - protein, 80 aa, synthetic construct
SQVTFSDVAIDFSHEEWACLDSAQRDLYKDVMVQNYENLVSVGLSVTKPYVIMLLEDGKEPWMMEKKLSKAYPFPLSHSV

SEQ ID NO: 608 - protein, 80 aa, synthetic construct
PGPLRSLEMESLQFRDVAVEFSLEEWHCLDTAQQNLYRDVMLENYRHLVFLGIIVSKPDLITCLEQGIKPLTMKRHEMIA

SEQ ID NO: 609 - protein, 80 aa, synthetic construct
LQTTWPQESVTFEDVAVYFTQNQWASLDPAQRALYGEVMLENYANVASLVAFPFPKPALISHLERGEAPWGPDPWDTEIL

SEQ ID NO: 610 - protein, 80 aa, synthetic construct
APLLAPRPGETRPGCRKPGTVSFADVAVYFSPEEWGCLRPAQRALYRDVMQETYGHLGALGFPGPKPALISWMEQESEAW

SEQ ID NO: 611 - protein, 80 aa, synthetic construct
NKVEQKSQESVSFKDVTVGFTQEEWQHLDPSQRALYRDVMLENYSNLVSVGYCVHKPEVIFRLQQGEEPWKQEEEFPSQS

SEQ ID NO: 612 - protein, 80 aa, synthetic construct
CFSQEERMAAGYLPRWSQELVTFEDVSMDFSQEEWELLEPAQKNLYREVMLENYRNVVSLEALKNQCTDVGIKEGPLSPA

SEQ ID NO: 613 - protein, 80 aa, synthetic construct
DSVAFEDVAVNFTQEEWALLDPSQKNLYREVMQETLRNLTSIGKKWNNQYIEDEHQNPRRNLRRLIGERLSESKESHQHG

SEQ ID NO: 614 - protein, 80 aa, synthetic construct
MGPAQVPMNSEVIVDPIQGQVNFEDVFVYFSQEEWVLLDEAQRLLYRDVMLENFALMASLGHTSFMSHIVASLVMGSEPW

SEQ ID NO: 615 - protein, 80 aa, synthetic construct
TTFKEAMTFKDVAVVFTEEELGLLDLAQRKLYRDVMLENFRNLLSVGHQAFHRDTFHFLREEKIWMMKTAIQREGNSGDK

SEQ ID NO: 616 - protein, 80 aa, synthetic construct
DSTLLQGGHNLLSSASFQEAVTFKDVIVDFTQEEWKQLDPGQRDLFRDVTLENYTHLVSIGLQVSKPDVISQLEQGTEPW

SEQ ID NO: 617 - protein, 80 aa, synthetic construct
EARSMLVPPQASVCFEDVAMAFTQEEWEQLDLAQRTLYREVTLETWEHIVSLGLFLSKSDVISQLEQEEDLCRAEQEAPR

SEQ ID NO: 618 - protein, 80 aa, synthetic construct
DSVVFEDVAVDFTLEEWALLDSAQRDLYRDVMLETFRNLASVDDGTQFKANGSVSLQDMYGQEKSKEQTIPNFTGNNSCA

SEQ ID NO: 619 - protein, 80 aa, synthetic construct
EESHGALISSCNSRTMTDGLVTFRDVAIDFSQEEWECLDPAQRDLYVDVMLENYSNLVSLDLESKTYETKKIFSENDIFE

SEQ ID NO: 620 - protein, 80 aa, synthetic construct
VITPQIPMVTEEFVKPSQGHVTFEDIAVYFSQEEWGLLDEAQRCLYHDVMLENFSLMASVGCLHGIEAEEAPSEQTLSAQ

SEQ ID NO: 621 - protein, 80 aa, synthetic construct
VQLRPQTRMATALRDPASGSVTFEDVAVYFSWEEWDLLDEAQKHLYFDVMLENFALTSSLGCWCGVEHEETPSEQRISGE

SEQ ID NO: 622 - protein, 80 aa, synthetic construct
MQAQESLTLEDVAVDFTWEEWQFLSPAQKDLYRDVMLENYSNLVAVGYQASKPDALSKLERGEETCTTEDEIYSRICSEI

SEQ ID NO: 623 - protein, 80 aa, synthetic construct
GPLQFRDVAIEFSLEEWHCLDTAQRNLYRDVMLENYRNLVFLGIVVSKPDLVTCLEQGKKPLTMERHEMIAKPPVMSSHF

SEQ ID NO: 624 - protein, 80 aa, synthetic construct
NMFKEAVTFKDVAVAFTEEELGLLGPAQRKLYRDVMVENFRNLLSVGHPPFKQDVSPIERNEQLWIMTTATRRQGNLGEK

SEQ ID NO: 625 - protein, 80 aa, synthetic construct
GALTFRDVAIEFSLEEWQCLDTEQQNLYRNVMLDNYRNLVFLGIAVSKPDLITCLEQEKEPWNLKTHDMVAKPPVICSHI

SEQ ID NO: 626 - protein, 80 aa, synthetic construct
SPQKSSALAPEDHGSSYEGSVSFRDVAIDFSREEWRHLDPSQRNLYRDVMLETYSHLLSVGYQVPEAEVVMLEQGKEPWA

SEQ ID NO: 627 - protein, 80 aa, synthetic construct
ELLTFRDVAIEFSPEEWKCLDPAQQNLYRDVMLENYRNLISLGVAISNPDLVIYLEQRKEPYKVKIHETVAKHPAVCSHF

SEQ ID NO: 628 - protein, 80 aa, synthetic construct
EPLKFRDVAIEFSLEEWQCLDTIQQNLYRNVMLENYRNLVFLGIVVSKPDLITCLEQEKEPWTRKRHRMVAEPPVICSHF

SEQ ID NO: 629 - protein, 80 aa, synthetic construct
PSARGKSKSKAPITFGDLAIYFSQEEWEWLSPIQKDLYEDVMLENYRNLVSLGLSFRRPNVITLLEKGKAPWMVEPVRRR

SEQ ID NO: 630 - protein, 80 aa, synthetic construct
TKAQESLTLEDVAVDFTWEEWQFLSPAQKDLYRDVMLENYSNLVSVGYQAGKPDALTKLEQGEPLWTLEDEIHSPAHPEI

SEQ ID NO: 631 - protein, 80 aa, synthetic construct
SQEEVEVAGIKLCKAMSLGSVTFTDVAIDFSQDEWEWLNLAQRSLYKKVMLENYRNLVSVGLCISKPDVISLLEQEKDPW

SEQ ID NO: 632 - protein, 80 aa, synthetic construct
TKSLESVSFKDVTVDFSRDEWQQLDLAQKSLYREVMLENYFNLISVGCQVPKPEVIFSLEQEEPCMLDGEIPSQSRPDGD

SEQ ID NO: 633 - protein, 80 aa, synthetic construct
SGCPGAERNLLVYSYFEKETLTFRDVAIEFSLEEWECLNPAQQNLYMNVMLENYKNLVFLGVAVSKQDPVTCLEQEKEPW

SEQ ID NO: 634 - protein, 80 aa, synthetic construct
PLQGSVSFKDVTVDFTQEEWQQLDPAQKALYRDVMLENYCHFVSVGFHMAKPDMIRKLEQGEELWTQRIFPSYSYLEEDG

SEQ ID NO: 635 - protein, 80 aa, synthetic construct
PGPPRSLEMGLLTFRDVAIEFSLEEWQHLDIAQQNLYRNVMLENYRNLAFLGIAVSKPDLITCLEQGKEPWNMKRHEMVD

SEQ ID NO: 636 - protein, 80 aa, synthetic construct
SGHPGSWEMNSVAFEDVAVNFTQEEWALLDPSQKNLYRDVMQETFRNLASIGNKGEDQSIEDQYKNSSRNLRHIISHSGN

SEQ ID NO: 637 - protein, 80 aa, synthetic construct
SYGSITFGDVAIDFSHQEWEYLSLVQKTLYQEVMMENYDNLVSLAGHSVSKPDLITLLEQGKEPWMIVREETRGECTDLD

SEQ ID NO: 638 - protein, 80 aa, synthetic construct
DLFVCSGLEPHTPSVGSQESVTFQDVAVDFTEKEWPLLDSSQRKLYKDVMLENYSNLTSLGYQVGKPSLISHLEQEEEPR

SEQ ID NO: 639 - protein, 80 aa, synthetic construct
FQTAWRQEPVTFEDVAVYFTQNEWASLDSVQRALYREVMLENYANVASLAFPFTTPVLVSQLEQGELPWGLDPWEPMGRE

SEQ ID NO: 640 - protein, 80 aa, synthetic construct
ELLTFRDVAIEFSPEEWKCLDPDQQNLYRDVMLENYRNLVSLGVAISNPDLVTCLEQRKEPYNVKIHKIVARPPAMCSHF

SEQ ID NO: 641 - protein, 80 aa, synthetic construct
AGEAEAQLDPSLQGLVMFEDVTVYFSREEWGLLNVTQKGLYRDVMLENFALVSSLGLAPSRSPVFTQLEDDEQSWVPSWV

SEQ ID NO: 642 - protein, 80 aa, synthetic construct
AHALVTFRDVAIDFSQKEWECLDTTQRKLYRDVMLENYNNLVSLGYSGSKPDVITLLEQGKEPCVVARDVTGRQCPGLLS

SEQ ID NO: 643 - protein, 80 aa, synthetic construct
KRIKHWKMASKLILPESLSLLTFEDVAVYFSEEEWQLLNPLEKTLYNDVMQDIYETVISLGLKLKNDTGNDHPISVSTSE

SEQ ID NO: 644 - protein, 80 aa, synthetic construct
DSVVFEDVAVDFTLEEWALLDSAQRDLYRDVMLETFQNLASVDDETQFKASGSVSQQDIYGEKIPKESKIATFTRNVSWA

SEQ ID NO: 645 - protein, 80 aa, synthetic construct
NMSQASVSFQDVTVEFTREEWQHLGPVERTLYRDVMLENYSHLISVGYCITKPKVISKLEKGEEPWSLEDEFLNQRYPGY

SEQ ID NO: 646 - protein, 80 aa, synthetic construct
ISFQESVTFQDVAVDFTAEEWQLLDCAERTLYWDVMLENYRNLISVGCPITKTKVILKVEQGQEPWMVEGANPHESSPES

SEQ ID NO: 647 - protein, 80 aa, synthetic construct
NTLQGPVSFKDVAVDFTQEEWQQLDPDEKITYRDVMLENYSHLVSVGYDTTKPNVIIKLEQGEEPWIMGGEFPCQHSPEA

SEQ ID NO: 648 - protein, 80 aa, synthetic construct
HPEEEERMHDELLQAVSKGPVMFRDVSIDFSQEEWECLDADQMNLYKEVMLENFSNLVSVGLSNSKPAVISLLEQGKEPW

SEQ ID NO: 649 - protein, 80 aa, synthetic construct
SLGSELFRDVAIVFSQEEWQWLAPAQRDLYRDVMLETYSNLVSLGLAVSKPDVISFLEQGKEPWMVERVVSGGLCPVLES

SEQ ID NO: 650 - protein, 80 aa, synthetic construct
TKFQEMVTFKDVAVVFTEEELGLLDSVQRKLYRDVMLENFRNLLLVAHQPFKPDLISQLEREEKLLMVETETPRDGCSGR

SEQ ID NO: 651 - protein, 80 aa, synthetic construct
AKRPGPPGSREMGLLTFRDIAIEFSLAEWQCLDHAQQNLYRDVMLENYRNLVSLGIAVSKPDLITCLEQNKEPQNIKRNE

SEQ ID NO: 652 - protein, 80 aa, synthetic construct
TCMVHRQTMSCSGAGGITAFVAFRDVAVYFTQEEWRLLSPAQRTLHREVMLETYNHLVSLEIPSSKPKLIAQLERGEAPW

SEQ ID NO: 653 - protein, 80 aa, synthetic construct
IQAQESITLEDVAVDFTWEEWQLLGAAQKDLYRDVMLENYSNLVAVGYQASKPDALFKLEQGEQLWTIEDGIHSGACSDI

SEQ ID NO: 654 - protein, 80 aa, synthetic construct
AQKRRKRKAKESGMALPQGHLTFRDVAIEFSQAEWKCLDPAQRALYKDVMLENYRNLVSLGISLPDLNINSMLEQRREPW

SEQ ID NO: 655 - protein, 80 aa, synthetic construct
DSTSVPVTAEAKLMGFTQGCVTFEDVAIYFSQEEWGLLDEAQRLLYRDVMLENFALITALVCWHGMEDEETPEQSVSVEG

SEQ ID NO: 656 - protein, 80 aa, synthetic construct
GPLTFRDVKIEFSLEEWQCLDTAQRNLYRDVMLENYRNLVFLGIAVSKPDLITWLEQGKEPWNLKRHEMVDKTPVMCSHF

SEQ ID NO: 657 - protein, 80 aa, synthetic construct
SGCPGAERSLLVQSYFEKGPLTFRDVAIEFSLEEWQCLDSAQQGLYRKVMLENYRNLVFLAGIALTKPDLITCLEQGKEP

SEQ ID NO: 658 - protein, 80 aa, synthetic construct
GVLTFRDVAVEFSPEEWECLDSAQQRLYRDVMLENYGNLVSLGLAIFKPDLMTCLEQRKEPWKVKRQEAVAKHPAGSFHF

SEQ ID NO: 659 - protein, 80 aa, synthetic construct
KENLEDISGWGLPEARSKESVSFKDVAVDFTQEEWGQLDSPQRALYRDVMLENYQNLLALGPPLHKPDVISHLERGEEPW

SEQ ID NO: 660 - protein, 80 aa, synthetic construct
EESEKPRGFARGLEPERIIGATDSSGELMFLMKWKNSDEADLVPAKEANVKCPQVVISFYEERLTWHSYPSEDDDKKDDK

SEQ ID NO: 661 - protein, 80 aa, synthetic construct
ASVALEDVAVNFTREEWALLGPCQKNLYKDVMQETIRNLDCVVMKWKDQNIEDQYRYPRKNLRCRMLERFVESKDGTQCG

SEQ ID NO: 662 - protein, 80 aa, synthetic construct
TLLTFRDVAIEFSLEEWKCLDLAQQNLYRDVMLENYRNLFSVGLTVCKPGLITCLEQRKEPWNVKRQEAADGHPEMGFHH

SEQ ID NO: 663 - protein, 80 aa, synthetic construct
AAALRAPTQQVFVAFEDVAIYFSQEEWELLDEMQRLLYRDVMLENFAVMASLGCWCGAVDEGTPSAESVSVEELSQGRTP

SEQ ID NO: 664 - protein, 80 aa, synthetic construct
NTFQASVSFQDVTVEFSQEEWQHMGPVERTLYRDVMLENYSHLVSVGYCFTKPELIFTLEQGEDPWLLEKEKGFLSRNSP

SEQ ID NO: 665 - protein, 80 aa, synthetic construct
DSVAFEDVSVSFSQEEWALLAPSQKKLYRDVMQETFKNLASIGEKWEDPNVEDQHKNQGRNLRSHTGERLCEGKEGSQCA

SEQ ID NO: 666 - protein, 80 aa, synthetic construct
AQGLVTFADVAIDFSQEEWACLNSAQRDLYWDVMLENYSNLVSLDLESAYENKSLPTEKNIHEIRASKRNSDRRSKSLGR

SEQ ID NO: 667 - protein, 80 aa, synthetic construct
AVDLLSAQEPVTFRDVAVFFSQDEWLHLDSAQRALYREVMLENYSSLVSLGIPFSMPKLIHQLQQGEDPCMVEREVPSDT

SEQ ID NO: 668 - protein, 80 aa, synthetic construct
SPQRFPALIPGEPGRSFEGSVSFEDVAVDFTRQEWHRLDPAQRTMHKDVMLETYSNLASVGLCVAKPEMIFKLERGEELW

SEQ ID NO: 669 - protein, 80 aa, synthetic construct
RVLTFRDVAVEFSPEEWECLDSAQQRLYRDVMLENYGNLFSLGLAIFKPDLITYLEQRKEPWNARRQKTVAKHPAGSLHF

SEQ ID NO: 670 - protein, 80 aa, synthetic construct
AETKDAAQMLVTFKDVAVTFTREEWRQLDLAQRTLYREVMLETCGLLVSLGHRVPKPELVHLLEHGQELWIVKRGLSHAT

SEQ ID NO: 671 - protein, 80 aa, synthetic construct
IEYQIPVSFKDVVVGFTQEEWHRLSPAQRALYRDVMLETYSNLVSVGYEGTKPDVILRLEQEEAPWIGEAACPGCHCWED

SEQ ID NO: 672 - protein, 80 aa, synthetic construct
TKFQEAVTFKDVAVAFTEEELGLLDSAQRKLYRDVMLENFRNLVSVGHQSFKPDMISQLEREEKLWMKELQTQRGKHSGD

SEQ ID NO: 673 - protein, 80 aa, synthetic construct
DEGVAGVMSVGPPAARLQEPVTFRDVAVDFTQEEWGQLDPTQRILYRDVMLETFGHLLSIGPELPKPEVISQLEQGTELW

SEQ ID NO: 674 - protein, 80 aa, synthetic construct
GPLTFMDVAIEFSVEEWQCLDTAQQNLYRNVMLENYRNLVFLGIAVSKPDLITCLEQGKEPWNMERHEMVAKPPGMCCYF

SEQ ID NO: 675 - protein, 80 aa, synthetic construct
HQVGLIRSYNSKTMTCFQELVTFRDVAIDFSRQEWEYLDPNQRDLYRDVMLENYRNLVSLGGHSISKPVVVDLLERGKEP

SEQ ID NO: 676 - protein, 80 aa, synthetic construct
NATIVMSVRREQGSSSGEGSLSFEDVAVGFTREEWQFLDQSQKVLYKEVMLENYINLVSIGYRGTKPDSLFKLEQGEPPG

SEQ ID NO: 677 - protein, 80 aa, synthetic construct
FPPARGKELLSFEDVAMYFTREEWGHLNWGQKDLYRDVMLENYRNMVLLGFQFPKPEMICQLENWDEQWILDLPRTGNRK

SEQ ID NO: 678 - protein, 80 aa, synthetic construct
ELLTFKDVAIEFSPEEWKCLDTSQQNLYRDVMLENYRNLVSLGVSISNPDLVTSLEQRKEPYNLKIHETAARPPAVCSHF

SEQ ID NO: 679 - protein, 80 aa, synthetic construct
MKSQGLVSFKDVAVDFTQEEWQQLDPSQRTLYRDVMLENYSHLVSMGYPVSKPDVISKLEQGEEPWIIKGDISNWIYPDE

SEQ ID NO: 680 - protein, 80 aa, synthetic construct
AEGSVMFSDVSIDFSQEEWDCLDPVQRDLYRDVMLENYGNLVSMGLYTPKPQVISLLEQGKEPWMVGRELTRGLCSDLES

SEQ ID NO: 681 - protein, 80 aa, synthetic construct
GPLTFTDVAIEFSLEEWQCLDTAQQNLYRNVMLENYRNLVFLGIAVSKPDLITCLEKEKEPCKMKRHEMVDEPPVVCSHF

SEQ ID NO: 682 - protein, 80 aa, synthetic construct
ALSQGLFTFKDVAIEFSQEEWECLDPAQRALYRDVMLENYRNLLSLDEDNIPPEDDISVGFTSKGLSPKENNKEELYHLV

SEQ ID NO: 683 - protein, 80 aa, synthetic construct
NMEGLVMFQDLSIDFSQEEWECLDAAQKDLYRDVMMENYSSLVSLGLSIPKPDVISLLEQGKEPWMVSRDVLGGWCRDSE

SEQ ID NO: 684 - protein, 80 aa, synthetic construct
AVSHLPTMVQESVTFKDVAILFTQEEWGQLSPAQRALYRDVMLENYSNLVSLGLLGPKPDTFSQLEKREVWMPEDTPGGF

SEQ ID NO: 685 - protein, 80 aa, synthetic construct
GPLTIRDVTVEFSLEEWHCLDTAQQNLYRDVMLENYRNLVFLGIAVSKPDLITCLEQGKEPCNMKRHEMVAKPPVMCSHI

SEQ ID NO: 686 - protein, 80 aa, synthetic construct
AAAVLTDRAQVSVTFDDVAVTFTKEEWGQLDLAQRTLYQEVMLENCGLLVSLGCPVPKAELICHLEHGQEPWTRKEDLSQ

SEQ ID NO: 687 - protein, 80 aa, synthetic construct
ALRSVMFSDVSIDFSPEEWEYLDLEQKDLYRDVMLENYSNLVSLGCFISKPDVISSLEQGKEPWKVVRKGRRQYPDLETK

SEQ ID NO: 688 - protein, 80 aa, synthetic construct
AHGSVTFRDVAIDFSQEEWEFLDPAQRDLYRDVMWENYSNFISLGPSISKPDVITLLDEERKEPGMVVREGTRRYCPDLE

SEQ ID NO: 689 - protein, 80 aa, synthetic construct
APRAQIQGPLTFGDVAVAFTRIEWRHLDAAQRALYRDVMLENYGNLVSVGLLSSKPKLITQLEQGAEPWTEVREAPSGTH

SEQ ID NO: 690 - protein, 80 aa, synthetic construct
GPLQFRDVAIEFSLEEWHCLDTAQRNLYRNVMLENYRNLVFLGIVVSKPDLITCLEQGKKPLTMKKHEMVANPSVTCSHF

SEQ ID NO: 691 - protein, 80 aa, synthetic construct
TLPRGQPEVLEWGLPKDQDSVAFEDVAVNFTHEEWALLGPSQKNLYRDVMRETIRNLNCIGMKWENQNIDDQHQNLRRNP

SEQ ID NO: 692 - protein, 80 aa, synthetic construct
PSPDSMTFEDIIVDFTQEEWALLDTSQRKLFQDVMLENISHLVSIGKQLCKSVVLSQLEQVEKLSTQRISLLQGREVGIK

SEQ ID NO: 693 - protein, 80 aa, synthetic construct
EESREIRAGQIVLKAMAQGLVTFRDVAIEFSLEEWKCLEPAQRDLYREVTLENFGHLASLGLSISKPDVVSLLEQGKEPW

SEQ ID NO: 694 - protein, 80 aa, synthetic construct
AASAQVSVTFEDVAVTFTQEEWGQLDAAQRTLYQEVMLETCGLLMSLGCPLFKPELIYQLDHRQELWMATKDLSQSSYPG

SEQ ID NO: 695 - protein, 80 aa, synthetic construct
RESLEDEVTPGLPTAESQELLTFKDISIDFTQEEWGQLAPAHQNLYREVMLENYSNLVSVGYQLSKPSVISQLEKGEEPW

SEQ ID NO: 696 - protein, 80 aa, synthetic construct
EGEYIKLKVIGQDSSEIHFKVKMTTHLKKLKESYCQRQGVPMNSLRFLFEGQRIADNHTPKELGMEEEDVIEVYQEQTGG

SEQ ID NO: 697 - protein, 80 aa, synthetic construct
NKSLGPVSFKDVAVDFTQEEWQQLDPEQKITYRDVMLENYSNLVSVGYHIIKPDVISKLEQGEEPWIVEGEFLLQSYPDE

SEQ ID NO: 698 - protein, 80 aa, synthetic construct
SPGLLTTRKEALMAFRDVAVAFTQKEWKLLSSAQRTLYREVMLENYSHLVSLGIAFSKPKLIEQLEQGDEPWREENEHLL

SEQ ID NO: 699 - protein, 80 aa, synthetic construct
MFQDSVAFEDVAVTFTQEEWALLDPSQKNLCRDVMQETFRNLASIGKKWKPQNIYVEYENLRRNLRIVGERLFESKEGHQ

SEQ ID NO: 700 - protein, 80 aa, synthetic construct
ENDHINLKVAGQDGSVVQFKIKRHTPLSKLMKAYCERQGLSMRQIRFRFDGQPINETDTPAQLEMEDEDTIDVFQQQTGG

SEQ ID NO: 701 - protein, 80 aa, synthetic construct
PGPLGSLEMGVLTFRDVALEFSLEEWQCLDTAQQNLYRNVMLENYRNLVFVGIAASKPDLITCLEQGKEPWNVKRHEMVT

SEQ ID NO: 702 - protein, 80 aa, synthetic construct
LSQKPQVLGPEKQDGSCEASVSFEDVTVDFSREEWQQLDPAQRCLYRDVMLELYSHLFAVGYHIPNPEVIFRMLKEKEPR

SEQ ID NO: 703 - protein, 80 aa, synthetic construct
ALTQGQVTFRDVAIEFSQEEWTCLDPAQRTLYRDVMLENYRNLASLGISCFDLSIISMLEQGKEPFTLESQVQIAGNPDG

SEQ ID NO: 704 - protein, 80 aa, synthetic construct
NKFQGPVTLKDVIVEFTKEEWKLLTPAQRTLYKDVMLENYSHLVSVGYHVNKPNAVFKLKQGKEPWILEVEFPHRGFPED

SEQ ID NO: 705 - protein, 80 aa, synthetic construct
ELLTFRDVAIEFSPEEWKCLDPAQQNLYRDVMLENYRNLVSLAVYSYYNQGILPEQGIQDSFKKATLGRYGSCGLENICL

SEQ ID NO: 706 - protein, 80 aa, synthetic construct
SPQKSSALAPEDHGSSYEGSVSFRDVAIDFSREEWRHLDLSQRNLYRDVMLETYSHLLSVGYQVPKPEVVMLEQGKEPWA

SEQ ID NO: 707 - protein, 80 aa, synthetic construct
NNSQGRVTFEDVTVNFTQGEWQRLNPEQRNLYRDVMLENYSNLVSVGQGETTKPDVILRLEQGKEPWLEEEEVLGSGRAE

SEQ ID NO: 708 - protein, 80 aa, synthetic construct
AMALPMPGPQEAVVFEDVAVYFTRIEWSCLAPDQQALYRDVMLENYGNLASLGFLVAKPALISLLEQGEEPGALILQVAE

SEQ ID NO: 709 - protein, 80 aa, synthetic construct
DSSQHLVTFEDVAVDFTQEEWTLLDQAQRDLYRDVMLENYKNLIILAGSELFKRSLMSGLEQMEELRTGVTGVLQELDLQ

SEQ ID NO: 710 - protein, 80 aa, synthetic construct
TTFKEAVTFKDVAVFFTEEELGLLDPAQRKLYQDVMLENFTNLLSVGHQPFHPFHFLREEKFWMMETATQREGNSGGKTI

SEQ ID NO: 711 - protein, 80 aa, synthetic construct
GPLQFRDVAIEFSLEEWHCLDMAQRNLYRDVMLENYRNLVFLGIVVSKPDLITHLEQGKKPSTMQRHEMVANPSVLCSHF

SEQ ID NO: 712 - protein, 80 aa, synthetic construct
NKSQGSVSFTDVTVDFTQEEWEQLDPSQRILYMDVMLENYSNLLSVEVWKADDQMERDHRNPDEQARQFLILKNQTPIEE

SEQ ID NO: 713 - protein, 80 aa, synthetic construct
EEEEMNDGSQMVRSQESLTFQDVAVDFTREEWDQLYPAQKNLYRDVMLENYRNLVALGYQLCKPEVIAQLELEEEWVIER

SEQ ID NO: 714 - protein, 80 aa, synthetic construct
EEATKKSKEKEPGMALPQGRLTFRDVAIEFSLEEWKCLNPAQRALYRAVMLENYRNLEFVDSSLKSMMEFSSTRHSITGE

SEQ ID NO: 715 - protein, 80 aa, synthetic construct
EKTPAGRIVADCLTDCYQDSVTFDDVAVDFTQEEWTLLDSTQRSLYSDVMLENYKNLATVGGQIIKPSLISWLEQEESRT

SEQ ID NO: 716 - protein, 80 aa, synthetic construct
AMSQESLTFKDVFVDFTLEEWQQLDSAQKNLYRDVMLENYSHLVSVGHLVGKPDVIFRLGPGDESWMADGGTPVRTCAGE

SEQ ID NO: 717 - protein, 80 aa, synthetic construct
DSVAFEDVAVNFTLEEWALLDPSQKNLYRDVMRETFRNLASVGKQWEDQNIEDPFKIPRRNISHIPERLCESKEGGQGEE

SEQ ID NO: 718 - protein, 80 aa, synthetic construct
MFQDSVAFEDVAVSFTQEEWALLDPSQKNLYRDVMQETFKNLTSVGKTWKVQNIEDEYKNPRRNLSLMREKLCESKESHH

SEQ ID NO: 719 - protein, 80 aa, synthetic construct
AVVATLRLSAQGTVTFEDVAVKFTQEEWNLLSEAQRCLYRDVTLENLALMSSLGCWCGVEDEAAPSKQSIYIQRETQVRT

SEQ ID NO: 720 - protein, 80 aa, synthetic construct
EEEEEDEDEDDLLTAGCQELVTFEDVAVYFSLEEWERLEADQRGLYQEVMQENYGILVSLGYPIPKPDLIFRLEQGEEPW

SEQ ID NO: 721 - protein, 80 aa, synthetic construct
TKFQEMVTFKDVAVVFTREELGLLDLAQRKLYQDVMLENFRNLLSVGYQPFKLDVILQLGKEDKLRMMETEIQGDGCSGH

SEQ ID NO: 722 - protein, 80 aa, synthetic construct
EEAAQKRKGKEPGMALPQGRLTFRDVAIEFSLAEWKCLNPSQRALYREVMLENYRNLEAVDISSKCMMKEVLSTGQGNTE

SEQ ID NO: 723 - protein, 80 aa, synthetic construct
DTVVFEDVVVDFTLEEWALLNPAQRKLYRDVMLETFKHLASVDNEAQLKASGSISQQDTSGEKLSLKQKIEKFTRKNIWA

SEQ ID NO: 724 - protein, 80 aa, synthetic construct
TTFKEGLTFKDVAVVFTEEELGLLDPVQRNLYQDVMLENFRNLLSVGHHPFKHDVFLLEKEKKLDIMKTATQRKGKSADK

SEQ ID NO: 725 - protein, 80 aa, synthetic construct
SALQQEFWKIQTSNGIQMDLVTFDSVAVEFTQEEWTLLDPAQRNLYSDVMLENYKNLSSVGYQLFKPSLISWLEEEEELS

SEQ ID NO: 726 - protein, 80 aa, synthetic construct
DCVIFEEVAVNFTPEEWALLDHAQRSLYRDVMLETCRNLASLDCYIYVRTSGSSSQRDVFGNGISNDEEIVKFTGSDSWS

SEQ ID NO: 727 - protein, 80 aa, synthetic construct
ELLTFRDVTIEFSLEEWEFLNPAQQSLYRKVMLENYRNLVSLGLTVSKPELISRLEQRQEPWNVKRHETIAKPPAMSSHY

SEQ ID NO: 728 - protein, 80 aa, synthetic construct
IKTQESLTLEDVAVEFSWEEWQLLDTAQKNLYRDVMVENYNHLVSLGYQTSKPDVLSKLAHGQEPWTTDAKIQNKNCPGI

SEQ ID NO: 729 - protein, 80 aa, synthetic construct
PAHVPGEAGPRRTRESRPGAVSFADVAVYFSPEEWECLRPAQRALYRDVMRETFGHLGALGFSVPKPAFISWVEGEVEAW

SEQ ID NO: 730 - protein, 80 aa, synthetic construct
GCPGDQVTPTRSLTAQLQETMTFKDVEVTFSQDEWGWLDSAQRNLYRDVMLENYRNMASLVGPFTKPALISWLEAREPWG

SEQ ID NO: 731 - protein, 80 aa, synthetic construct
ARDLVMFRDVAVDFSQEEWECLNSYQRNLYRDVILENYSNLVSLAGCSISKPDVITLLEQGKEPWMVVRDEKRRWTLDLE

SEQ ID NO: 732 - protein, 80 aa, synthetic construct
TTLKEAVTFKDVAVVFTEEELRLLDLAQRKLYREVMLENFRNLLSVGHQSLHRDTFHFLKEEKFWMMETATQREGNLGGK

SEQ ID NO: 733 - protein, 80 aa, synthetic construct
SPPSPRSSMAAVALRDSAQGMTFEDVAIYFSQEEWELLDESQRFLYCDVMLENFAHVTSLGYCHGMENEAIASEQSVSIQ

SEQ ID NO: 734 - protein, 80 aa, synthetic construct
DEEAQKRKAKESGMALPQGRLTFMDVAIEFSQEEWKSLDPGQRALYRDVMLENYRNLVFLGICLPDLSIISMLKQRREPL

SEQ ID NO: 735 - protein, 80 aa, synthetic construct
ALTQGPLKFMDVAIEFSQEEWKCLDPAQRTLYRDVMLENYRNLVSLGICLPDLSVTSMLEQKRDPWTLQSEEKIANDPDG

SEQ ID NO: 736 - protein, 80 aa, synthetic construct
TMFKEAVTFKDVAVVFTEEELGLLDVSQRKLYRDVMLENFRNLLSVGHQLSHRDTFHFQREEKFWIMETATQREGNSGGK

SEQ ID NO: 737 - protein, 80 aa, synthetic construct
QGTVAFEDVAVNFSQEEWSLLSEVQRCLYHDVMLENWVLISSLGCWCGSEDEEAPSKKSISIQRVSQVSTPGAGVSPKKA

SEQ ID NO: 738 - protein, 80 aa, synthetic construct
AEAFGDSEEDGEDVFEVEKILDMKTEGGKVLYKVRWKGYTSDDDTWEPEIHLEDCKEVLLEFRKKIAENKAKAVRKDIQR

SEQ ID NO: 739 - protein, 80 aa, synthetic construct
VLQMQNSEHHGQSIKTQTDSISLEDVAVNFTLEEWALLDPGQRNIYRDVMRATFKNLACIGEKWKDQDIEDEHKNQGRNL

SEQ ID NO: 740 - protein, 80 aa, synthetic construct
AMALTDPAQVSVTFDDVAVTFTQEEWGQLDLAQRTLYQEVMLENCGLLVSLGCPVPRPELIYHLEHGQEPWTRKEDLSQG

SEQ ID NO: 741 - protein, 80 aa, synthetic construct
VHGSVTFRDVAIDFSQEEWECLQPDQRTLYRDVMLENYSHLISLGSSISKPDVITLLEQEKEPWIVVSKETSRWYPDLES

SEQ ID NO: 742 - protein, 80 aa, synthetic construct
DPVACEDVAVNFTQEEWALLDISQRKLYREVMLETFRNLTSIGKKWKDQNIEYEYQNPRRNFRSLIEGNVNEIKEDSHCG

SEQ ID NO: 743 - protein, 80 aa, synthetic construct
IKFQERVTFKDVAVVFTKEELALLDKAQINLYQDVMLENFRNLMLVRDGIKNNILNLQAKGLSYLSQEVLHCWQIWKQRI

SEQ ID NO: 744 - protein, 80 aa, synthetic construct
GPLTFRDVAIEFSLKEWQCLDTAQRNLYRNVMLENYRNLVFLGITVSKPDLITCLEQGKEAWSMKRHEIMVAKPTVMCSH

SEQ ID NO: 745 - protein, 80 aa, synthetic construct
TMSKEAVTFKDVAVVFTEEELGLLDLAQRKLYRDVMLENFRNLLSVGHQPFHRDTFHFLREEKFWMMDIATQREGNSGGK

SEQ ID NO: 746 - protein, 80 aa, synthetic construct
GPLEFRDVAIEFSLEEWHCLDTAQQNLYRDVMLENYRHLVFLGIVVTKPDLITCLEQGKKPFTVKRHEMIAKSPVMCFHF

SEQ ID NO: 747 - protein, 80 aa, synthetic construct
GHTEGGELVNELLKSWLKGLVTFEDVAVEFTQEEWALLDPAQRTLYRDVMLENCRNLASLGNQVDKPRLISQLEQEDKVM

SEQ ID NO: 748 - protein, 80 aa, synthetic construct
AEPASVTVTFDDVALYFSEQEWEILEKWQKQMYKQEMKTNYETLDSLGYAFSKPDLITWMEQGRMLLISEQGCLDKTRRT

SEQ ID NO: 749 - protein, 80 aa, synthetic construct
HSQASAISQDREEKIMSQEPLSFKDVAVVFTEEELELLDSTQRQLYQDVMQENFRNLLSVGERNPLGDKNGKDTEYIQDE

SEQ ID NO: 750 - protein, 80 aa, synthetic construct
GSLEEGRRATGLPAAQVQEPVTFKDVAVDFTQEEWGQLDLVQRTLYRDVMLETYGHLLSVGNQIAKPEVISLLEQGEEPW

SEQ ID NO: 751 - protein, 80 aa, synthetic construct
TTFKEAVTFKDVAVVFTEEELGLLDPAQRKLYRDVMLENFRNLLSVGHQPFHQDTCHFLREEKFWMMGTATQREGNSGGK

SEQ ID NO: 752 - protein, 80 aa, synthetic construct
AKLYEAVTFKDVAVIFTEEELGLLDPAQRKLYRDVMLENFRNLLSVGGKIQTEMETVPEAGTHEEFSCKQIWEQIASDLT

SEQ ID NO: 753 - protein, 80 aa, synthetic construct
RSDLFLPDSQTNEERKQYDSVAFEDVAVNFTQEEWALLGPSQKSLYRDVMWETIRNLDCIGMKWEDTNIEDQHRNPRRSL

SEQ ID NO: 754 - protein, 80 aa, synthetic construct
PGTPGSLEMGLLTFRDVAIEFSPEEWQCLDTAQQNLYRNVMLENYRNLAFLGIALSKPDLITYLEQGKEPWNMKQHEMVD

SEQ ID NO: 755 - protein, 80 aa, synthetic construct
TPGVRVSTDPEQVTFEDVVVGFSQEEWGQLKPAQRTLYRDVMLDTFRLLVSVGHWLPKPNVISLLEQEAELWAVESRLPQ

SEQ ID NO: 756 - protein, 80 aa, synthetic construct
EQTQAAGMVAGWLINCYQDAVTFDDVAVDFTQEEWTLLDPSQRDLYRDVMLENYENLASVEWRLKTKGPALRQDRSWFRA

SEQ ID NO: 757 - protein, 80 aa, synthetic construct
PSEANSIQSANATTKTSETNHTSRPRLKNVDRSTAQQLAVTVGNVTVIITDFKEKTRSSSTSSSTVTSSAGSEQQNQSSS

SEQ ID NO: 758 - protein, 80 aa, synthetic construct
ALTQGQLSFSDVAIEFSQEEWKCLDPGQKALYRDVMLENYRNLVSLGEDNVRPEACICSGICLPDLSVTSMLEQKRDPWT

SEQ ID NO: 759 - protein, 80 aa, synthetic construct
AAAAALRAPAQSSVTFEDVAVNFSLEEWSLLNEAQRCLYRDVMLETLTLISSLGCWHGGEDEAAPSKQSTCIHIYKDQGG

SEQ ID NO: 760 - protein, 80 aa, synthetic construct
AQGSVSFNDVTVDFTQEEWQHLDHAQKTLYMDVMLENYCHLISVGCHMTKPDVILKLERGEEPWTSFAGHTCLEENWKAE

SEQ ID NO: 761 - protein, 80 aa, synthetic construct
DPVAFKDVAVNFTQEEWALLDISQRKLYREVMLETFRNLTSLGKRWKDQNIEYEHQNPRRNFRSLIEEKVNEIKDDSHCG

SEQ ID NO: 762 - protein, 80 aa, synthetic construct
SKDLVTFGDVAVNFSQEEWEWLNPAQRNLYRKVMLENYRSLVSLGVSVSKPDVISLLEQGKEPWMVKKEGTRGPCPDWEY

SEQ ID NO: 763 - protein, 80 aa, synthetic construct
DSVAFEDVAINFTCEEWALLGPSQKSLYRDVMQETIRNLDCIGMIWQNHDIEEDQYKDLRRNLRCHMVERACEIKDNSQC

SEQ ID NO: 764 - protein, 80 aa, synthetic construct
GPLTFMDVAIEFCLEEWQCLDIAQQNLYRNVMLENYRNLVFLGIAVSKPDLITCLEQEKEPWEPMRRHEMVAKPPVMCSH

SEQ ID NO: 765 - protein, 80 aa, synthetic construct
QSNDIARGFERGLEPEKIIGATDSCGDLMFLMKWKDTDEADLVLAKEANVKCPQIVIAFYEERLTWHAYPEDAENKEKET

SEQ ID NO: 766 - protein, 80 aa, synthetic construct
ALPAKDSAWPWEEKPRYLGPVTFEDVAVLFTEAEWKRLSLEQRNLYKEVMLENLRNLVSLAESKPEVHTCPSCPLAFGSQ

SEQ ID NO: 767 - protein, 80 aa, synthetic construct
DAKSLTAWSRTLVTFKDVFVDFTREEWKLLDTAQQIVYRNVMLENYKNLVSLGYQLTKPDVILRLEKGEEPWLVEREIHQ

SEQ ID NO: 768 - protein, 80 aa, synthetic construct
DAVAFEDVAVNFTQEEWALLGPSQKNLYRYVMQETIRNLDCIRMIWEEQNTEDQYKNPRRNLRCHMVERFSESKDSSQCG

SEQ ID NO: 769 - protein, 80 aa, synthetic construct
EKTKVERMVEDYLASGYQDSVTFDDVAVDFTPEEWALLDTTEKYLYRDVMLENYMNLASVEWEIQPRTKRSSLQQGFLKN

SEQ ID NO: 770 - protein, 80 aa, synthetic construct
DSVAFEDVDVNFTQEEWALLDPSQKNLYRDVMWETMRNLASIGKKWKDQNIKDHYKHRGRNLRSHMLERLYQTKDGSQRG

SEQ ID NO: 771 - protein, 80 aa, synthetic construct
IESQEPVTFEDVAVDFTQEEWQQLNPAQKTLHRDVMLETYNHLVSVGCSGIKPDVIFKLEHGKDPWIIESELSRWIYPDR

SEQ ID NO: 772 - protein, 80 aa, synthetic construct
AVGLCKAMSQGLVTFRDVALDFSQEEWEWLKPSQKDLYRDVMLENYRNLVWLGLSISKPNMISLLEQGKEPWMVERKMSQ

SEQ ID NO: 773 - protein, 80 aa, synthetic construct
DKVEEEAMAPGLPTACSQEPVTFADVAVVFTPEEWVFLDSTQRSLYRDVMLENYRNLASVADQLCKPNALSYLEERGEQW

SEQ ID NO: 774 - protein, 80 aa, synthetic construct
TFEDVAVYFSQEEWGLLDTAQRALYRHVMLENFTLVTSLGLSTSRPRVVIQLERGEEPWVPSGKDMTLARNTYGRLNSGS

SEQ ID NO: 775 - protein, 80 aa, synthetic construct
AEPPRLPLTFEDVAIYFSEQEWQDLEAWQKELYKHVMRSNYETLVSLDDGLPKPELISWIEHGGEPFRKWRESQKSGNII

SEQ ID NO: 776 - protein, 80 aa, synthetic construct
DSVVFEDVAVNFTQEEWALLGPSQKKLYRDVMQETFVNLASIGENWEEKNIEDHKNQGRKLRSHMVERLCERKEGSQFGE

SEQ ID NO: 777 - protein, 80 aa, synthetic construct
AAAALRDPAQGCVTFEDVTIYFSQEEWVLLDEAQRLLYCDVMLENFALIASLGLISFRSHIVSQLEMGKEPWVPDSVDMT

SEQ ID NO: 778 - protein, 80 aa, synthetic construct
AAPALALVSFEDVVVTFTGEEWGHLDLAQRTLYQEVMLETCRLLVSLGHPVPKPELIYLLEHGQELWTVKRGLSQSTCAG

SEQ ID NO: 779 - protein, 80 aa, synthetic construct
IKSQESLTLEDVAVEFTWEEWQLLGPAQKDLYRDVMLENYSNLVSVGYQASKPDALFKLEQGEPWTVENEIHSQICPEIK

SEQ ID NO: 780 - protein, 80 aa, synthetic construct
GESLESRVTLGSLTAESQELLTFKDVSVDFTQEEWGQLAPAHRNLYREVMLENYGNLVSVGCQLSKPGVISQLEKGEEPW

SEQ ID NO: 781 - protein, 80 aa, synthetic construct
ASVALEDVAVNFTREEWALLGPCQKNLYKDVMQETIRNLDCVGMKWKDQNIEDQYRYPRKNLRCRMLERFVESKDGTQCG

SEQ ID NO: 782 - protein, 80 aa, synthetic construct
TESQGTVTFKDVAIDFTQEEWKRLDPAQRKLYRNVMLENYNNLITVGYPFTKPDVIFKLEQEEEPWVMEEEVLRRHWQGE

SEQ ID NO: 783 - protein, 80 aa, synthetic construct
DSVASEDVAVNFTLEEWALLDPSQKKLYRDVMRETFRNLACVGKKWEDQSIEDWYKNQGRILRNHMEEGLSESKEYDQCG

SEQ ID NO: 784 - protein, 80 aa, synthetic construct
EETQGELTSSCGSKTMANVSLAFRDVSIDLSQEEWECLDAVQRDLYKDVMLENYSNLVSLGYTIPKPDVITLLEQEKEPW

SEQ ID NO: 785 - protein, 80 aa, synthetic construct
AAILLTTRPKVPVSFEDVSVYFTKTEWKLLDLRQKVLYKRVMLENYSHLVSLGFSFSKPHLISQLERGEGPWVADIPRTW

SEQ ID NO: 786 - protein, 80 aa, synthetic construct
KDKVEKEKSEKETTSKKNSHKKTRPRLKNVDRSSAQHLEVTVGDLTVIITDFKEKTKSPPASSAASADQHSQSGSSSDNT

SEQ ID NO: 787 - protein, 80 aa, synthetic construct
GPLTFTDVAIKFSLEEWQFLDTAQQNLYRDVMLENYRNLVFLGVGVSKPDLITCLEQGKEPWNMKRHKMVAKPPVVCSHF

SEQ ID NO: 788 - protein, 80 aa, synthetic construct
RKPNPQAMAALFLSAPPQAEVTFEDVAVYLSREEWGRLGPAQRGLYRDVMLETYGNLVSLGVGPAGPKPGVISQLERGDE

SEQ ID NO: 789 - protein, 80 aa, synthetic construct
LSLSPILLYTCEMFQDPVAFKDVAVNFTQEEWALLDISQKNLYREVMLETFWNLTSIGKKWKDQNIEYEYQNPRRNFRSV

SEQ ID NO: 790 - protein, 80 aa, synthetic construct
AAGEPRSLLFFQKPVTFEDVAVNFTQEEWDCLDASQRVLYQDVMSETFKNLTSVARIFLHKPELITKLEQEEEQWRETRV

SEQ ID NO: 791 - protein, 80 aa, synthetic construct
AAMPLKAQYQEMVTFEDVAVHFTKTEWTGLSPAQRALYRSVMLENFGNLTALGYPVPKPALISLLERGDMAWGLEAQDDP

SEQ ID NO: 792 - protein, 80 aa, synthetic construct
ARVPLTFSDVAIDFSQEEWEYLNSDQRDLYRDVMLENYTNLVSLDFNFTTESNKLSSEKRNYEVNAYHQETWKRNKTFNL

SEQ ID NO: 793 - protein, 80 aa, synthetic construct
ASRLPTAWSCEPVTFEDVTLGFTPEEWGLLDLKQKSLYREVMLENYRNLVSVEHQLSKPDVVSQLEEAEDFWPVERGIPQ

SEQ ID NO: 794 - protein, 80 aa, synthetic construct
SKKKRDAADKPRGFARGLDPERIIGATDSSGELMFLMKWKDSDEADLVLAKEANMKCPQIVIAFYEERLTWHSCPEDEAQ

SEQ ID NO: 795 - protein, 80 aa, synthetic construct
AHKYVGLQYHGSVTFEDVAIAFSQQEWESLDSSQRGLYRDVMLENYRNLVSMGHSRSKPHVIALLEQWKEPEVTVRKDGR

SEQ ID NO: 796 - protein, 80 aa, synthetic construct
AAARLLPVPAGPQPLSFQAKLTFEDVAVLLSQDEWDRLCPAQRGLYRNVMMETYGNVVSLGLPGSKPDIISQLERGEDPW

SEQ ID NO: 797 - protein, 80 aa, synthetic construct
AVGLLKAMYQELVTFRDVAVDFSQEEWDCLDSSQRHLYSNVMLENYRILVSLGLCFSKPSVILLLEQGKAPWMVKRELTK

SEQ ID NO: 798 - protein, 80 aa, synthetic construct
GLLTFRDVAIEFSLEEWQCLDTAQRNLYKNVILENYRNLVFLGIAVSKQDLITCLEQEKEPLTVKRHEMVNEPPVMCSHF

SEQ ID NO: 799 - protein, 80 aa, synthetic construct
GLLAFRDVALEFSPEEWECLDPAQRSLYRDVMLENYRNLISLGEDSFNMQFLFHSLAMSKPELIICLEARKEPWNVNTEK

SEQ ID NO: 800 - protein, 80 aa, synthetic construct
NLTEGRVVFEDVAIYFSQEEWGHLDEAQRLLYRDVMLENLALLSSLGSWHGAEDEEAPSQQGFSVGVSEVTASKPCLSSQ

SEQ ID NO: 801 - protein, 80 aa, synthetic construct
GPAQHTSWPCGSAVPTLKSMVTFEDVAVYFSQEEWELLDAAQRHLYHSVMLENLELVTSLGSWHGVEGEGAHPKQNVSVE

SEQ ID NO: 802 - protein, 80 aa, synthetic construct
SGYPGAERNLLEYSYFEKGPLTFRDVVIEFSQEEWQCLDTAQQDLYRKVMLENFRNLVFLGIDVSKPDLITCLEQGKDPW

SEQ ID NO: 803 - protein, 80 aa, synthetic construct
ARKLVMFRDVAIDFSQEEWECLDSAQRDLYRDVMLENYSNLVSLDLPSRCASKDLSPEKNTYETELSQWEMSDRLENCDL

SEQ ID NO: 804 - protein, 80 aa, synthetic construct
GPLQFRDVAIEFSLEEWHCLDTAQRNLYRNVMLENYSNLVFLGITVSKPDLITCLEQGRKPLTMKRNEMIAKPSVMCSHF

SEQ ID NO: 805 - protein, 80 aa, synthetic construct
VAGWLTNYSQDSVTFEDVAVDFTQEEWTLLDQTQRNLYRDVMLENYKNLVAVDWESHINTKWSAPQQNFLQGKTSSVVEM

SEQ ID NO: 806 - protein, 80 aa, synthetic construct
AAAWMAPAQESVTFEDVAVTFTQEEWGQLDVTQRALYVEVMLETCGLLVALGDSTKPETVEPIPSHLALPEEVSLQEQLA

SEQ ID NO: 807 - protein, 80 aa, synthetic construct
VLEWLFISQEQPKITKSWGPLSFMDVFVDFTWEEWQLLDPAQKCLYRSVMLENYSNLVSLGYQHTKPDIIFKLEQGEELC

SEQ ID NO: 808 - protein, 80 aa, synthetic construct
AAAVLMDRVQSCVTFEDVFVYFSREEWELLEEAQRFLYRDVMLENFALVATLGFWCEAEHEAPSEQSVSVEGVSQVRTAE

SEQ ID NO: 809 - protein, 80 aa, synthetic construct
AGSQFPDFKHLGTFLVFEELVTFEDVLVDFSPEELSSLSAAQRNLYREVMLENYRNLVSLGHQFSKPDIISRLEEEESYA

SEQ ID NO: 810 - protein, 80 aa, synthetic construct
IQSQISFEDVAVDFTLEEWQLLNPTQKNLYRDVMLENYSNLVFLEVWLDNPKMWLRDNQDNLKSMERGHKYDVFGKIFNS

SEQ ID NO: 811 - protein, 80 aa, synthetic construct
DLVAFEDVAVNFTQEEWSLLDPSQKNLYREVMQETLRNLASIGEKWKDQNIEDQYKNPRNNLRSLLGERVDENTEENHCG

SEQ ID NO: 812 - protein, 80 aa, synthetic construct
KDEDIKLRVIGQDSSEIHFKVKMTTPLKKLKKSYCQRQGVPVNSLRFLFEGQRIADNHTPEELGMEEEDVIEVYQEQIGG

SEQ ID NO: 813 - protein, 80 aa, synthetic construct
DSVAFEDVAVNFTQEEWALLSPSQKNLYRDVTLETFRNLASVGIQWKDQDIENLYQNLGIKLRSLVERLCGRKEGNEHRE

SEQ ID NO: 814 - protein, 80 aa, synthetic construct
RNFWILRLPPGSKGEAPKVPVTFDDVAVYFSELEWGKLEDWQKELYKHVMRGNYETLVSLDYAISKPDILTRIERGEEPC

SEQ ID NO: 815 - protein, 80 aa, synthetic construct
AAAAPRRPTQQGTVTFEDVAVNFSQEEWCLLSEAQRCLYRDVMLENLALISSLGCWCGSKDEEAPCKQRISVQRESQSRT

SEQ ID NO: 816 - protein, 80 aa, synthetic construct
SGEDSGSFYSWQKAKREQGLVTFEDVAVDFTQEEWQYLNPPQRTLYRDVMLETYSNLVFVGQQVTKPNLILKLEVEECPA

SEQ ID NO: 817 - protein, 80 aa, synthetic construct
DSVAFEDVAVNFTQEEWALLGPSQKSLYRNVMQETIRNLDCIEMKWEDQNIGDQCQNAKRNLRSHTCEIKDDSQCGETFG

SEQ ID NO: 818 - protein, 80 aa, synthetic construct
AAGWLTTWSQNSVTFQEVAVDFSQEEWALLDPAQKNLYKDVMLENFRNLASVGYQLCRHSLISKVDQEQLKTDERGILQG

SEQ ID NO: 819 - protein, 80 aa, synthetic construct
ENPRNQLMALMLLTAQPQELVMFEEVSVCFTSEEWACLGPIQRALYWDVMLENYGNVTSLEWETMTENEEVTSKPSSSQR

SEQ ID NO: 820 - protein, 80 aa, synthetic construct
LETYNSLVSLQELVSFEEVAVHFTWEEWQDLDDAQRTLYRDVMLETYSSLVSLGHCITKPEMIFKLEQGAEPWIVEETPN

SEQ ID NO: 821 - protein, 80 aa, synthetic construct
RHFRRPEPCREPLASPIQDSVAFEDVAVNFTQEEWALLDSSQKNLYREVMQETCRNLASVGSQWKDQNIEDHFEKPGKDI

SEQ ID NO: 822 - protein, 80 aa, synthetic construct
AAAELTAPAQGIVTFEDVAVYFSWKEWGLLDEAQKCLYHDVMLENLTLTTSLGGSGAGDEEAPYQQSTSPQRVSQVRIPK

SEQ ID NO: 823 - protein, 80 aa, synthetic construct
AATFQLPGHQEMPLTFQDVAVYFSQAEGRQLGPQQRALYRDVMLENYGNVASLGFPVPKPELISQLEQGKELWVLNLLGA

SEQ ID NO: 824 - protein, 80 aa, synthetic construct
RSEAGEPPSSLQVKPETPASAAVAVAAAAAPTTTAEKPPAEAQDEPAESLSEFKPFFGNIIITDVTANCLTVTFKEYVTV

SEQ ID NO: 825 - protein, 80 aa, synthetic construct
HRTTRIKITELNPHLMCALCGGYFIDATTIVECLHSFCKTCIVRYLETNKYCPMCDVQVHKTRPLLSIRSDKTLQDIVYK

SEQ ID NO: 826 - protein, 80 aa, synthetic construct
ASQEFEVEAIVDKRQDKNGNTQYLVRWKGYDKQDDTWEPEQHLMNCEKCVHDFNRRQTEKQKKLTWTTTSRIFSNNARRR

SEQ ID NO: 827 - protein, 80 aa, synthetic construct
ASGDLYEVERIVDKRKNKKGKWEYLIRWKGYGSTEDTWEPEHHLLHCEEFIDEFNGLHMSKDKRIKSGKQSSTSKLLRDS

SEQ ID NO: 828 - protein, 80 aa, synthetic construct
TLIRKADLENHNKDGGFWTVIDGKVYDIKDFQTQSLTGNSILAQFAGEDPVVALEAALQFEDTRESMHAFCVGQYLEPDQ

SEQ ID NO: 829 - protein, 80 aa, synthetic construct
EKTKIGTMVEDHRSNSYQDSVTFDDVAVEFTPEEWALLDTTQKYLYRDVMLENYMNLASVDFFFCLTSEWEIQPRTKRSS

SEQ ID NO: 830 - protein, 80 aa, synthetic construct
AHELVMFRDVAIDVSQEEWECLNPAQRNLYKEVMLENYSNLVSLGLSVSKPAVISSLEQGKEPWMVVREETGRWCPGTWK

SEQ ID NO: 831 - protein, 80 aa, synthetic construct
AFEDVAVYFSQEEWGLLDTAQRALYRRVMLDNFALVASLGLSTSRPRVVIQLERGEEPWVPSGTDTTLSRTTYRRRNPGS

SEQ ID NO: 832 - protein, 80 aa, synthetic construct
AQLRRGHLTFRDVAIEFSQEEWKCLDPVQKALYRDVMLENYRNLVSLGICLPDLSIISMMKQRTEPWTVENEMKVAKNPD

SEQ ID NO: 833 - protein, 80 aa, synthetic construct
SDHSLGISRSKTPVDDPMSLLYNMNDCYSKLKELVPSIPQNKKVSKMEILQHVIDYILDLQIALDSHPTIVSLHHQRPGQ

SEQ ID NO: 834 - protein, 80 aa, synthetic construct
KDPNEPQKPVSAYALFFRDTQAAIKGQNPNATFGEVSKIVASMWDGLGEEQKQVYKKKTEAAKKEYLKQLAAYRASLVSK

SEQ ID NO: 835 - protein, 80 aa, synthetic construct
QEEKQEDAAICPVTVLPEEPVTFQDVAVDFSREEWGLLGPTQRTEYRDVMLETFGHLVSVGWETTLENKELAPNSDIPEE

SEQ ID NO: 836 - protein, 80 aa, synthetic construct
DASRLSGRDPSSWTVEDVMQFVREADPQLGPHADLFRKHEIDGKALLLLRSDMMMKYMGLKLGPALKLSYHIDRLKQGKF

SEQ ID NO: 837 - protein, 80 aa, synthetic construct
AVTFEDVTIIFTWEEWKFLDSSQKRLYREVMWENYTNVMSVENWNESYKSQEEKFRYLEYENFSYWQGWWNAGAQMYENQ

SEQ ID NO: 838 - protein, 80 aa, synthetic construct
ELSAIGEQVFAVESIRKKRVRKGKVEYLVKWKGWPPKYSTWEPEEHILDPRLVMAYEEKEERDRASGYRKRGPKPKRLLL

SEQ ID NO: 839 - protein, 80 aa, synthetic construct
GGAGARLPALLDEQQVNVLLYDMNGCYSRLKELVPTLPQNRKVSKVEILQHVIDYIRDLQLELNSESEVGTPGGRGLPVR

SEQ ID NO: 840 - protein, 80 aa, synthetic construct
VVMAASPGSLHSPQQLAEEATRKRELRLMKNREAAKECRRRKKEYVKCLESRVAVLEVQNKKLIEELETLKDICSPKTDY

SEQ ID NO: 841 - protein, 80 aa, synthetic construct
GGGPGGRPGREPRQRHTANARERDRTNSVNTAFTALRTLIPTEPADRKLSKIETLRLASSYISHLGNVLLAGEACGDGQP

SEQ ID NO: 842 - protein, 80 aa, synthetic construct
SGFGYSLPQQQPAAVARRNERERNRVKLVNLGFATLREHVPNGAANKKMSKVETLRSAVEYIRALQQLLDEHDAVSAAFQ

SEQ ID NO: 843 - protein, 80 aa, synthetic construct
APLPPRDPNGAGPEWREPGAVSFADVAVYFCREEWGCLRPAQRALYRDVMRETYGHLSALGIGGNKPALISWVEEEAELW

SEQ ID NO: 844 - protein, 80 aa, synthetic construct
KQGFSKDPSTWSVDEVIQFMKHTDPQISGPLADLFRQHEIDGKALFLLKSDVMMKYMGLKLGPALKLCYYIEKLKEGKYS

SEQ ID NO: 845 - protein, 80 aa, synthetic construct
SGGGSPQSYEELQTQRVMANVRERQRTQSLNEAFAALRKIIPTLPSDKLSKIQTLKLAARYIDFLYQVLQSDELDSKMAS

SEQ ID NO: 846 - protein, 80 aa, synthetic construct
IAPGVVMASSPALPTQPAEEAARKREVRLMKNREAARECRRKKKEYVKCLENRVAVLENQNKTLIEELKALKDLYCHKSD

SEQ ID NO: 847 - protein, 80 aa, synthetic construct
SRIPVSKSQPVTPEKHRARKRQAWLWEEDKNLRSGVRKYGEGNWSKILLHYKFNNRTSVMLKDRWRTMKKLKLISSDSED

SEQ ID NO: 848 - protein, 80 aa, synthetic construct
SLAIARGRGKGPAAEEPLSLLDDMNHCYSRLRELVPGVPRGTQLSQVEILQRVIDYILDLQVVLAEPAPGPPDGPHLPIQ

SEQ ID NO: 849 - protein, 80 aa, synthetic construct
GSGPPSSGGGLYRDMGAQGGRPSLIARIPVARILGDPEEESWSPSLTNLEKVVVTDVTSNFLTVTIKESNTDQGFFKEKR

SEQ ID NO: 850 - protein, 80 aa, synthetic construct
ELPAVGEHVFAVESIEKKRIRKGRVEYLVKWRGWSPKYNTWEPEENILDPRLLIAFQNRERQEQLMGYRKRGPKPKPLVV

SEQ ID NO: 851 - protein, 80 aa, synthetic construct
VDSSSNQLPSSKRMRTAFTSTQLLELEREFASNMYLSRLRRIEIATYLNLSEKQVKIWFQNRRVKHKKEGKGSNHRGGGG

SEQ ID NO: 852 - protein, 80 aa, synthetic construct
TPGGGGDAGKKRKRRVLFSKAQTYELERRFRQQRYLSAPEREHLASLIRLTPTQVKIWFQNHRYKMKRARAEKGMEVTPL

SEQ ID NO: 853 - protein, 80 aa, synthetic construct
QTVVMTSPVTLTSQTTKTDDPQLKREIRLMKNREAARECRRKKKEYVKCLENRVAVLENQNKTLIEELKTLKDLYSNKSV

SEQ ID NO: 854 - protein, 80 aa, synthetic construct
KGSPSAQSFEELQSQRILANVRERQRTQSLNEAFAALRKIIPTLPSDKLSKIQTLKLAARYIDFLYQVLQSDEMDNKMTS

SEQ ID NO: 855 - protein, 80 aa, synthetic construct
NLTEDYMVFEDVAIHFSQEEWGILNDVQRHLHSDVMLENFALLSSVGCWHGAKDEEAPSKQCVSVGVSQVTTLKPALSTQ

SEQ ID NO: 856 - protein, 80 aa, synthetic construct
KDPNEPQKPVSAYALFFRDTQAAIKGQNPNATFGEVSKIVASMWDSLGEEQKQVYKRKTEAAKKEYLKALAAYRASLVSK

SEQ ID NO: 857 - protein, 80 aa, synthetic construct
KDPNEPQKPVSAYALFFRDTQAAIKGQNPNATFGEVSKIVASMWDSLGEEQKQVYKRKTEAAKKEYLKALAAYKDNQECQ

SEQ ID NO: 858 - protein, 80 aa, synthetic construct
LDGSTWDFCSEDCKSKYLLWYCKAARCHACKRQGKLLETIHWRGQIRHFCNQQCLLRFYSQQNQPNLDTQSGPESLLNSQ

SEQ ID NO: 859 - protein, 80 aa, synthetic construct
ASVQASRRQWCYLCDLPKMPWAMVWDFSEAVCRGCVNFEGADRIELLIDAARQLKRSHVLPEGRSPGPPALKHPATKDLA

SEQ ID NO: 860 - protein, 80 aa, synthetic construct
MEGPQPENMQPRTRRTKFTLLQVEELESVFRHTQYPDVPTRRELAENLGVTEDKVRVWFKNKRARCRRHQRELMLANELR

SEQ ID NO: 861 - protein, 80 aa, synthetic construct
PKIMPKKPAEEGNDSEEVPEASGPQNDGKELCPPGKPTTSEKIHERSGPKRGEHAWTHRLRERKQLVIYEEISDPEEDDE

SEQ ID NO: 862 - protein, 80 aa, synthetic construct
SAAQVSSSRRQSCYLCDLPRMPWAMIWDFSEPVCRGCVNYEGADRIEFVIETARQLKRAHGCFQDGRSPGPPPPVGVKTV

SEQ ID NO: 863 - protein, 80 aa, synthetic construct
PGPPGSLEMGPLTFRDVAIEFSLEEWQCLDTAQRNLYRKVMFENYRNLVFLGIAVSKPHLITCLEQGKEPWNRKRQEMVA

SEQ ID NO: 864 - protein, 80 aa, synthetic construct
NKKKVEEVLEEEEEEYVVEKVLDRRVVKGKVEYLLKWKGFSDEDNTWEPEENLDCPDLIAEFLQSQKTAHETDKSEGGKR

SEQ ID NO: 865 - protein, 80 aa, synthetic construct
LANVVEKVRLLRLHPGMGLKGDLCERHGEKLKMFCKEDVLIMCEACSQSPEHEAHSVVPMEDVAWEYKWELHEALEHLKK

SEQ ID NO: 866 - protein, 80 aa, synthetic construct [sequence omitted]

SEQ ID NO: 867 - protein, 80 aa, synthetic construct
ENSDLLPVAQTEPSIWTVDDVWAFIHSLPGCQDIADEFRAQEIDGQALLLLKEDHLMSAMNIKLGPALKICARINSLKES

SEQ ID NO: 868 - protein, 80 aa, synthetic construct
AGPGGGSRSGSGRPAAANAARERSRVQTLRHAFLELQRTLPSVPPDTKLSKLDVLLLATTYIAHLTRSLQDDAEAPADAG

SEQ ID NO: 869 - protein, 80 aa, synthetic construct
QNGKSKKVEEAEPEEFVVEKVLDRRVVNGKVEYFLKWKGFTDADNTWEPEENLDCPELIEAFLNSQKAGKEKDGTKRKSL

SEQ ID NO: 870 - protein, 80 aa, synthetic construct
QHPPDACAFRRGRKKRIPYSKGQLRELEREYAANKFITKDKRRKISAATSLSERQITIWFQNRRVKEKKVLAKVKNSATP

SEQ ID NO: 871 - protein, 80 aa, synthetic construct
SMSPTTSSQILARKRRRGIIEKRRRDRINNSLSELRRLVPSAFEKQGSAKLEKAEILQMTVDHLKMLHTAGGKGYFDAHA

SEQ ID NO: 872 - protein, 80 aa, synthetic construct
LVGMGHHFLPSEPTKWNVEDVYEFIRSLPGCQEIAEEFRAQEIDGQALLLLKEDHLMSAMNIKLGPALKIYARISMLKDS

SEQ ID NO: 873 - protein, 80 aa, synthetic construct
PANEDAPQPGEHGSACEVSVSFEDVTVDFSREEWQQLDSTQRRLYQDVMLENYSHLLSVGFEVPKPEVIFKLEQGEGPWT

SEQ ID NO: 874 - protein, 80 aa, synthetic construct
GYSSTENLQLVLERRRVANAKERERIKNLNRGFARLKALVPFLPQSRKPSKVDILKGATEYIQVLSDLLEGAKDSKKQDP

SEQ ID NO: 875 - protein, 80 aa, synthetic construct
EEAPAPEDVTKWTVDDVCSFVGGLSGCGEYTRVFREQGIDGETLPLLTEEHLLTNMGLKLGPALKIRAQVARRLGRVFYV

SEQ ID NO: 876 - protein, 80 aa, synthetic construct
GGTLAHTPRRSLPSHHGKKMRMARCGHCRGCLRVQDCGSCVNCLDKPKFGGPNTKKQCCVYRKCDKIEARKMERLAKKGR

SEQ ID NO: 877 - protein, 80 aa, synthetic construct
LNSPTTTSQIMARKKRRGIIEKRRRDRINNSLSELRRLVPTAFEKQGSAKLEKAEILQMTVDHLKMLQATGGKGYFDAHA

SEQ ID NO: 878 - protein, 80 aa, synthetic construct
QPVKSELDEEEERRKRRREKNKVAAARCRNKKKERTEFLQRESERLELMNAELKTQIEELKQERQQLILMLNRHRPTCIV

SEQ ID NO: 879 - protein, 80 aa, synthetic construct
LQPEVSSYRRGRKKRVPYTKVQLKELEKEYAASKFITKEKRRRISATTNLSERQVTIWFQNRRVKEKKVVSKSKAPHLHS

SEQ ID NO: 880 - protein, 80 aa, synthetic construct
LPVPLDSAFEPAFLRKRNERERQRVRCVNEGYARLRDHLPRELADKRLSKVETLRAAIDYIKHLQELLERQAWGLEGAAG

SEQ ID NO: 881 - protein, 80 aa, synthetic construct
SPFLQRPLHKRKGGQVRFSNDQTIELEKKFETQKYLSPPERKRLAKMLQLSERQVKTWFQNRRAKWRRLKQENPQSNKKE

SEQ ID NO: 882 - protein, 80 aa, synthetic construct
IAIATGSLHCVCCTEDGEVYTWGDNDEGQLGDGTTNAIQRPRLVAALQGKKVNRVACGSAHTLAWSTSKPASAGKLPAQV

SEQ ID NO: 883 - protein, 80 aa, synthetic construct
GGSDASQVPNGKRMRTAFTSTQLLELEREFSSNMYLSRLRRIEIATYLNLSEKQVKIWFQNRRVKHKKEGKGTQRNSHAG

SEQ ID NO: 884 - protein, 80 aa, synthetic construct
RLDLPPGFMFKVQAQHDYTATDTDELQLKAGDVVLVIPFQNPEEQDEGWLMGVKESDWNQHKELEKCRGVFPENFTERVP

SEQ ID NO: 885 - protein, 80 aa, synthetic construct
GICKLPGRLRIQPALWSREDVLHWLRWAEQEYSLPCTAEHGFEMNGRALCILTKDDFRHRAPSSGDVLYELLQYIKTQRR

SEQ ID NO: 886 - protein, 80 aa, synthetic construct
PNYRGCEYSYGPAFTRKRNERERQRVKCVNEGYAQLRHHLPEEYLEKRLSKVETLRAAIKYINYLQSLLYPDKAETKNNP

SEQ ID NO: 887 - protein, 80 aa, synthetic construct
LHGINPVFLSSNPSRWSVEEVYEFIASLQGCQEIAEEFRSQEIDGQALLLLKEEHLMSAMNIKLGPALKICAKINVLKET

SEQ ID NO: 888 - protein, 80 aa, synthetic construct
QAGQQQGQQKQKRHRTRFTPAQLNELERSFAKTHYPDIFMREELALRIGLTESRVQVWFQNRRAKWKKRKKTTNVFRAPG

SEQ ID NO: 889 - protein, 80 aa, synthetic construct
AAAVAVAAASRRQSCYLCDLPRMPWAMIWDFTEPVCRGCVNYEGADRVEFVIETARQLKRAHGCFPEGRSPPGAAASAAA

SEQ ID NO: 890 - protein, 80 aa, synthetic construct
FSSQTPASIKEEEGSPEKERPPEAEYINSRCVLFTYFQGDISSVVDEHFSRALSQPSSYSPSCTSSKAPRSSGPWRDCSF

SEQ ID NO: 891 - protein, 80 aa, synthetic construct
DKAGGSSGQRTRKKRCPYTKYQIRELEREFFFSVYINKEKRLQLSRMLNLTDRQVKIWFQNRRMKEKKINRDRLQYYSAN

SEQ ID NO: 892 - protein, 80 aa, synthetic construct
GAPLSGLQGLPECTRCGHGIVGTIVKARDKLYHPECFMCSDCGLNLKQRGYFFLDERLYCESHAKARVKPPEGYDVVAVY

SEQ ID NO: 893 - protein, 80 aa, synthetic construct
RRPATAETGGGAAAVARRNERERNRVKLVNLGFQALRQHVPHGGASKKLSKVETLRSAVEYIRALQRLLAEHDAVRNALA

SEQ ID NO: 894 - protein, 80 aa, synthetic construct
TVQVTGKTRTKEKYRVVYTDHQRLELEKEFHCNRYITIQRKSELAVNLGLSERQVKIWFQNRRAKERKMIKKKISQFENS

SEQ ID NO: 895 - protein, 80 aa, synthetic construct
EEAAQKRKEKEPGMALPQGHLTFRDVAIEFSLEEWKCLDPTQRALYRAMMLENYRNLHSVDISSKCMMKKFSSTAQGNTE

SEQ ID NO: 896 - protein, 80 aa, synthetic construct
DIRASQVARWTVDEVAEFVQSLLGCEEHAKCFKKEQIDGKAFLLLTQTDIVKVMKIKLGPALKIYNSILMFRHSQELPEE

SEQ ID NO: 897 - protein, 80 aa, synthetic construct
LSPLEGTKMTVNNLHPRVTEEDIVELFCVCGALKRARLVHPGVAEVVFVKKDDAITAYKKYNNRCLDGQPMKCNLHMNGN

SEQ ID NO: 898 - protein, 80 aa, synthetic construct
DNAERPRARRRRKPRVLFSQAQVYELERRFKQQRYLSAPERDQLASVLKLTSTQVKIWFQNRRYKCKRQRQDQTLELVGL

SEQ ID NO: 899 - protein, 80 aa, synthetic construct
SQVKSKAKKTVDKHSDEYKIRRERNNIAVRKSRDKAKMRNLETQHKVLELTAENERLQKKVEQLSRELSTLRNLFKQLPE

SEQ ID NO: 900 - protein, 80 aa, synthetic construct
KRDYIRLYGIKCAKCSIGFSKNDFVMRARSKVYHIECFRCVACSRQLIPGDEFALREDGLFCRADHDVVERASLGAGDPL

SEQ ID NO: 901 - protein, 80 aa, synthetic construct
SLGSQVKTRTKDKYRVVYTDHQRLELEKEFHYSRYITIRRKAELAATLGLSERQVKIWFQNRRAKERKINKKKLQQQQQQ

SEQ ID NO: 902 - protein, 80 aa, synthetic construct
QGGQRGRPHSRRRHRTTFSPVQLEQLESAFGRNQYPDIWARESLARDTGLSEARIQVWFQNRRAKQRKQERSLLQPLAHL

SEQ ID NO: 903 - protein, 80 aa, synthetic construct
DALTYLDQVKIRFGSDPATYNGFLEIMKEFKSQSIDTPGVIRRVSQLFHEHPDLIVGFNAFLPLGYRIDIPKNGKLNIQS

SEQ ID NO: 904 - protein, 80 aa, synthetic construct
RLHLDSNPLKWSVADVVRFIRSTDCAPLARIFLDQEIDGQALLLLTLPTVQECMDLKLGPAIKLCHHIERIKFAFYEQFA

SEQ ID NO: 905 - protein, 80 aa, synthetic construct
AKGAAPNAPRTRKKRCPYSKFQIRELEREFFFNVYINKEKRLQLSRMLNLTDRQVKIWFQNRRMKEKKLSRDRLQYFSGN

SEQ ID NO: 906 - protein, 80 aa, synthetic construct
TTGNWLTAKSGRKKRCPYTKHQTLELEKEFLFNMYLTRERRLEISKTINLTDRQVKIWFQNRRMKLKKMNRENRIRELTS

SEQ ID NO: 907 - protein, 80 aa, synthetic construct
YLVSNVIELLDVDPNDQEEDGANIDLDSQRKGKCAVIKTSTRQTYFLPVIGLVDAEKLKPGDLVGVNKDSYLILETLPTE

SEQ ID NO: 908 - protein, 80 aa, synthetic construct
KASPTLGKRKKRRHRTVFTAHQLEELEKAFSEAHYPDVYAREMLAVKTELPEDRIQVWFQNRRAKWRKREKRWGGSSVMA

SEQ ID NO: 909 - protein, 80 aa, synthetic construct
EESERPKPRSRRKPRVLFSQAQVFELERRFKQQRYLSAPEREHLASSLKLTSTQVKIWFQNRRYKCKRQRQDKSLELGAH

SEQ ID NO: 910 - protein, 80 aa, synthetic construct
VVPGSRQEEVIDHKLTEREWAEEWKHLNNLLNCIMDMVEKTRRSLTVLRRCQEADREELNHWARRYSDAEDTKKGPAPAA

SEQ ID NO: 911 - protein, 80 aa, synthetic construct
ESPEKKPACRKKKTRTVFSRSQVFQLESTFDMKRYLSSSERAGLAASLHLTETQVKIWFQNRRNKWKRQLAAELEAANLS

SEQ ID NO: 912 - protein, 80 aa, synthetic construct
RGGVGVGGGRKKKTRTVFSRSQVFQLESTFDLKRYLSSAERAGLAASLQLTETQVKIWFQNRRNKWKRQLAAELEAASLS

SEQ ID NO: 913 - protein, 80 aa, synthetic construct
ELLAHGRQKILDLLNEGSARDLRSLQRIGPKKAQLIVGWRELHGPFSQVEDLERVEGITGKQMESFLKANILGLAAGQRC

SEQ ID NO: 914 - protein, 80 aa, synthetic construct
ESPYGETISPEDAPESISKAVASLPPEQMFELMKQMKLCVQNSPQEARNMLLQNPQLAYALLQAQVVMRIVDPEIALKIL

SEQ ID NO: 915 - protein, 80 aa, synthetic construct
AGPLHKGKKAVNKDSLEYRLRRERNNIAVRKSRDKAKRRILETQQKVLEYMAENERLRSRVEQLTQELDTLRNLFRQIPE

SEQ ID NO: 916 - protein, 80 aa, synthetic construct
IRIVNGKPKKVRKPRTIYSSFQLAALQRRFQKTQYLALPERAELAASLGLTQTQVKIWFQNRRSKFKKMWKSGEIPSEQH

SEQ ID NO: 917 - protein, 80 aa, synthetic construct
TVYQFCSPSCWTKFQRTSPEGGIHLSCHYCHSLFSGKPEVLDWQDQVFQFCCRDCCEDFKRLRGVVSQCEHCRQEKLLHE

SEQ ID NO: 918 - protein, 80 aa, synthetic construct
TMVDTEMPFWPTNFGISSVDLSVMEDHSHSFDIKPFTTVDFSSISTPHYEDIPFTRTDPVVADYKYDLKLQEYQSAIKVE

SEQ ID NO: 919 - protein, 80 aa, synthetic construct
GRHHAELLKPRCSACDEIIFADECTEAEGRHWHMKHFCCLECETVLGGQRYIMKDGRPFCCGCFESLYAEYCETCGEHIG

SEQ ID NO: 920 - protein, 80 aa, synthetic construct
DPDKESPGCKRRRTRTNFTGWQLEELEKAFNESHYPDVFMREALALRLDLVESRVQVWFQNRRAKWRKKENTKKGPGRPA

SEQ ID NO: 921 - protein, 80 aa, synthetic construct
TEQPTPRQKKPRRSRTIFTELQLMGLEKKFQKQKYLSTPDRLDLAQSLGLTQLQVKTWYQNRRMKWKKMVLKGGQEAPTK

SEQ ID NO: 922 - protein, 80 aa, synthetic construct
SMELAKNKSKKRRNRTTFSTFQLEELEKVFQKTHYPDVYAREQLALRTDLTEARVQVWFQNRRAKWRKRERYGKIQEGRN

SEQ ID NO: 923 - protein, 80 aa, synthetic construct
GGGGGAGPVVVVRQRQAANARERDRTQSVNTAFTALRTLIPTEPVDRKLSKIETVRLASSYIAHLANVLLLGDSADDGQP

SEQ ID NO: 924 - protein, 80 aa, synthetic construct
IDDTVEGITGNLFEVYLKPYFLEAYRPIRKGDIFLVRGGMRAVEFKVVETDPSPYCIVAPDTVIHCEGEPIKREDEEESL

SEQ ID NO: 925 - protein, 80 aa, synthetic construct
SALNQTKKRKKRRHRTIFTSYQLEELEKAFNEAHYPDVYAREMLAMKTELPEDRIQVWFQNRRAKWRKREKCWGRSSVMA

SEQ ID NO: 926 - protein, 80 aa, synthetic construct
DGLPWGAAPGRARKKRKPYTKQQIAELENEFLVNEFINRQKRKELSNRLNLSDQQVKIWFQNRRMKKKRVVLREQALALY

SEQ ID NO: 927 - protein, 80 aa, synthetic construct
GGGGSGKTRTKDKYRVVYTDHQRLELEKEFHYSRYITIRRKSELAANLGLTERQVKIWFQNRRAKERKVNKKKQQQQQPP

SEQ ID NO: 928 - protein, 80 aa, synthetic construct
TRAGGLALGRSEASPENAARERSRVRTLRQAFLALQAALPAVPPDTKLSKLDVLVLAASYIAHLTRTLGHELPGPAWPPF

SEQ ID NO: 929 - protein, 80 aa, synthetic construct
KCDSNVSSSKKRRHRTTFTSLQLEELEKVFQKTHYPDVYVREQLALRTELTEARVQVWFQNRRAKWRKRERYGQIQQAKS

SEQ ID NO: 930 - protein, 80 aa, synthetic construct
NAANWLTAKSGRKKRCPYTKHQTLELEKEFLFNMYLTRERRLEISRSVHLTDRQVKIWFQNRRMKLKKMNRENRIRELTA

SEQ ID NO: 931 - protein, 80 aa, synthetic construct
LSEEEQPKKKHRRNRTTFTTYQLHELERAFEKSHYPDVYSREELAGKVNLPEVRVQVWFQNRRAKWRRQEKLEVSSMKLQ

SEQ ID NO: 932 - protein, 80 aa, synthetic construct
HMAGLAEYPMQGELASAISSGKKKRKRCGMCAPCRRRINCEQCSSCRNRKTGHQICKFRKCEELKKKPSAALEKVMLPTG

SEQ ID NO: 933 - protein, 80 aa, synthetic construct
SITKHPSTWSVEAVVLFLKQTDPLALCPLVDLFRSHEIDGKALLLLTSDVLLKHLGVKLGTAVKLCYYIDRLKQGKCFEN

SEQ ID NO: 934 - protein, 80 aa, synthetic construct
ACRRKREFIPDEKKDAMYWEKRRKNNEAAKRSREKRRLNDLVLENKLIALGEENATLKAELLSLKLKFGLISSTAYAQEI

SEQ ID NO: 935 - protein, 80 aa, synthetic construct
EIRFNGKGKKIRKPRTIYSSLQLQALNHRFQQTQYLALPERAELAASLGLTQTQVKIWFQNKRSKFKKLLKQGSNPHESD

SEQ ID NO: 936 - protein, 80 aa, synthetic construct
GLHGTRQEEMIDHRLTDREWAEEWKHLDHLLNCIMDMVEKTRRSLTVLRRCQEADREELNYWIRRYSDAEDLKKGGGSSS

SEQ ID NO: 937 - protein, 80 aa, synthetic construct
ELSAVGERVFAAEALLKRRIRKGRMEYLVKWKGWSQKYSTWEPEENILDARLLAAFEEREREMELYGPKKRGPKPKTFLL

SEQ ID NO: 938 - protein, 80 aa, synthetic construct
AREKSAGKRGPDRGSPEYRQRRERNNIAVRKSRDKAKRRNQEMQQKLVELSAENEKLHQRVEQLTRDLAGLRQFFKQLPS

SEQ ID NO: 939 - protein, 80 aa, synthetic construct
SGGCDNLIKLWKEEEDGQWKEEQKLEAHSDWVRDVAWAPSIGLPTSTIASCSQDGRVFIWTCDDASSNTWSPKLLHKFND

SEQ ID NO: 940 - protein, 80 aa, synthetic construct
VKGVDLDAPGSINGVPLLEVDLDSFEDKPWRKPGADLSDYFNYGFNEDTWKAYCEKQKRIRMGLEVIPVTSTTNKITAED

SEQ ID NO: 941 - protein, 80 aa, synthetic construct
KADSESNKGKKRRNRTTFTSYQLEELEKVFQKTHYPDVYAREQLAMRTDLTEARVQVWFQNRRAKWRKRERFGQMQQVRT

SEQ ID NO: 942 - protein, 80 aa, synthetic construct
TAKQREAEATAKRPRTTITAKQLETLKSAYNTSPKPARHVREQLSSETGLDMRVVQVWFQNRRAKEKRLKKDAGRQRWGQ

SEQ ID NO: 943 - protein, 80 aa, synthetic construct
GRHHAECLKPRCAACDEIIFADECTEAEGRHWHMKHFCCFECETVLGGQRYIMKEGRPYCCHCFESLYAEYCDTCAQHIG

SEQ ID NO: 944 - protein, 80 aa, synthetic construct
IIGGDRPDEFLQVKNVLKDGPAAQDGKIAPGDVIVDINGNCVLGHTHADVVQMFQLVPVNQYVNLTLCRGYPLPDDSEDP

SEQ ID NO: 945 - protein, 80 aa, synthetic construct
CCPECDTRVTSQCLDQNGHKLYRSGDNWTHSCQQCRCLEGEVDCWPLTCPNLSCEYTAILEGECCPRCVSDPCLADNITY

SEQ ID NO: 946 - protein, 80 aa, synthetic construct
LNSEEKKKRKQRRNRTTFNSSQLQALERVFERTHYPDAFVREDLARRVNLTEARVQVWFQNRRAKFRRNERAMLANKNAS

SEQ ID NO: 947 - protein, 80 aa, synthetic construct
GLNGGYQDELVDHRLTEREWADEWKHLDHALNCIMEMVEKTRRSMAVLRRCQESDREELNYWKRRYNENTELRKTGTELV

SEQ ID NO: 948 - protein, 80 aa, synthetic construct
GPGEEAPKKKHRRNRTTFTTYQLHQLERAFEASHYPDVYSREELAAKVHLPEVRVQVWFQNRRAKWRRQERLESGSGAVA

SEQ ID NO: 949 - protein, 80 aa, synthetic construct
VRMVNGKPKKVRKPRTIYSSYQLAALQRRFQKAQYLALPERAELAAQLGLTQTQVKIWFQNRRSKFKKLYKNGEVPLEHS

SEQ ID NO: 950 - protein, 80 aa, synthetic construct
EVRFNGKGKKIRKPRTIYSSLQLQALNRRFQQTQYLALPERAELAASLGLTQTQVKIWFQNKRSKFKKLMKQGGAALEGS

SEQ ID NO: 951 - protein, 80 aa, synthetic construct
GRSEQPKARQRRKPRVLFSQAQVLALERRFKQQRYLSAPEREHLASALQLTSTQVKIWFQNRRYKCKRQRQDKSLELAGH

SEQ ID NO: 952 - protein, 80 aa, synthetic construct
LPRTLGELQLYRILQKANLLSYFDAFIQQGGDDVQQLCEAGEEEFLEIMALVGMASKPLHVRRLQKALRDWVTNPGLFNQ

SEQ ID NO: 953 - protein, 80 aa, synthetic construct
NLSLDEDIQKWTVDDVHSFIRSLPGCSDYAQVFKDHAIDGETLPLLTEEHLRGTMGLKLGPALKIQSQVSQHVGSMFYKK

SEQ ID NO: 954 - protein, 80 aa, synthetic construct
SPEDGSLKKKQRRQRTHFTSQQLQELEATFQRNRYPDMSTREEIAVWTNLTEARVRVWFKNRRAKWRKRERSQQAELCKG

SEQ ID NO: 955 - protein, 80 aa, synthetic construct
SNLLVSASDDKTLKIWDVSSGKCLKTLKGHSNYVFCCNFNPQSNLIVSGSFDESVRIWDVKTGKCLKTLPAHSDPVSAVH

SEQ ID NO: 956 - protein, 80 aa, synthetic construct
GNYKSEVNSKPRKERTAFTKEQIRELEAEFAHHNYLTRLRRYEIAVNLDLTERQVKVWFQNRRMKWKRVKGGQQGAAARE

SEQ ID NO: 957 - protein, 80 aa, synthetic construct
LPRTLGELQLYRVLQRANLLSYYETFIQQGGDDVQQLCEAGEEEFLEIMALVGMATKPLHVRRLQKALREWATNPGLFSQ

SEQ ID NO: 958 - protein, 80 aa, synthetic construct
PEEPTIGDIYNGKVTSIMQFGCFVQLEGLRKRWEGLVHISELRREGRVANVADVVSKGQRVKVKVLSFTGTKTSLSMKDV

SEQ ID NO: 959 - protein, 80 aa, synthetic construct
YAFNHPFSINNLMSSEQQHHHSHHHHQPHKMDLKAYEQVMHYPGYGSPMPGSLAMGPVTNKTGLDASPLAADTSYYQGVY

SEQ ID NO: 960 - protein, 80 aa, synthetic construct
TAAAGPAPPTAPEPAGASSEPEAGDWRPEMSPCSNVVVTDVTSNLLTVTIKEFCNPEDFEKVAAGVAGAAGGGGSIGASK

SEQ ID NO: 961 - protein, 80 aa, synthetic construct
FLLHNALARKPKRIRTAFSPSQLLRLEHAFEKNHYVVGAERKQLAHSLSLTETQVKVWFQNRRTKFKRQKLEEEGSDSQQ

SEQ ID NO: 962 - protein, 80 aa, synthetic construct
KRIALYIGNLTWWTTDEDLTEAVHSLGVNDILEIKFFENRANGQSKGFALVGVGSEASSKKLMDLLPKRELHGQNPVVTP

SEQ ID NO: 963 - protein, 80 aa, synthetic construct
SGAPWYPINSRSRKKRKPYSKLQLAELEGEFLVNEFITRQRRRELSDRLNLSDQQVKIWFQNRRMKKKRLLLREQALSFF

SEQ ID NO: 964 - protein, 80 aa, synthetic construct
SDNLYPESITSRDCVQLGPPSEGELVELRWTDGNLYKAKFISSVTSHIYQVEFEDGSQLTVKRGDIFTLEEELPKRVRSR

SEQ ID NO: 965 - protein, 80 aa, synthetic construct
GIPASKVSKWSTDEVSEFIQSLPGCEEHGKVFKDEQIDGEAFLLMTQTDIVKIMSIKLGPALKIFNSILMFKAAEKNSHN

SEQ ID NO: 966 - protein, 80 aa, synthetic construct
EPSGLHEKRKQRRIRTTFTSAQLKELERVFAETHYPDIYTREELALKIDLTEARVQVWFQNRRAKFRKQERAASAKGAAG

SEQ ID NO: 967 - protein, 80 aa, synthetic construct
LLLHGPFARKPKRIRTAFSPSQLLRLERAFEKNHYVVGAERKQLAGSLSLSETQVKVWFQNRRTKYKRQKLEEEGPESEQ

SEQ ID NO: 968 - protein, 80 aa, synthetic construct
SSGNDDDLTIPRAAINKMIKETLPNVRVANDARELVVNCCTEFIHLISSEANEICNKSEKKTISPEHVIQALESLGFGSY

SEQ ID NO: 969 - protein, 80 aa, synthetic construct
ERRPQAPAKKLRKPRTIYSSLQLQHLNQRFQHTQYLALPERAQLAAQLGLTQTQVKIWFQNKRSKYKKLLKQNSGGQEGD

SEQ ID NO: 970 - protein, 80 aa, synthetic construct
NVQDRVKRPMNAFIVWSRDQRRKMALENPRMRNSEISKQLGYQWKMLTEAEKWPFFQEAQKLQAMHREKYPNYKYRPRRK

SEQ ID NO: 971 - protein, 80 aa, synthetic construct
EITRLAVWAAVQAVERKLEAQAMRLLTLEGRTGTNEKKIADCEKTAVEFANHLESKWVVLGTLLQEYGLLQRRLENMENL

SEQ ID NO: 972 - protein, 80 aa, synthetic construct
CEKDIDECSEGIIECHNHSRCVNLPGWYHCECRSGFHDDGTYSLSGESCIDIDECALRTHTCWNDSACINLAGGFDCLCP

SEQ ID NO: 973 - protein, 80 aa, synthetic construct
AAISLWTVVAAVQAIERKVEIHSRRLLHLEGRTGTAEKKLASCEKTVTELGNQLEGKWAVLGTLLQEYGLLQRRLENLEN

SEQ ID NO: 974 - protein, 80 aa, synthetic construct
GQNRPLIKPKRRLSAARRAGTSCANCQTTTTTLWRRNANGDPVCNACGLYYKLHNINRPLTMKKEGIQTRNRKMSSKSKK

SEQ ID NO: 975 - protein, 80 aa, synthetic construct
HAELPGKHCRRRKARTVFSDSQLSGLEKRFEIQRYLSTPERVELATALSLSETQVKTWFQNRRMKHKKQLRKSQDEPKAP

SEQ ID NO: 976 - protein, 80 aa, synthetic construct
QDATVYVGGLDEKVSEPLLWELFLQAGPVVNTHMPKDRVTGQHQGYGFVEFLSEEDADYAIKIMNMIKLYGKPIRVNKAS

SEQ ID NO: 977 - protein, 80 aa, synthetic construct
PIDNDAEGVWSPDIEQSFQEALAIYPPCGRRKIILSDEGKMYGRNELIARYIKLRTGKTRTRKQVSSHIQVLARRKSRDF

SEQ ID NO: 978 - protein, 80 aa, synthetic construct
GLDNDAEGVWSPDIEQSFQEALAIYPPCGRRKIILSDEGKMYGRNELIARYIKLRTGKTRTRKQVSSHIQVLARKKVREY

SEQ ID NO: 979 - protein, 80 aa, synthetic construct
DSVGTPQSNGGMRLHDFVSKTVIKPESCVPCGKRIKFGKLSLKCRDCRVVSHPECRDRCPLPCIPTLIGTPVKIGEGMLA

SEQ ID NO: 980 - protein, 80 aa, synthetic construct
SAPHSMTASSSSVSSPSPGLPRRSAPPSPLCRSLSPGTGGGVRGGVGYLSRGDPVRVLARRVRPDGSVQYLVEWGGGGIF

SEQ ID NO: 981 - protein, 80 aa, synthetic construct
GDPHYSFNHPFSINNLMSSSEQQHKLDFKAYEQALQYSPYGSTLPASLPLGSASVTTRSPIEPSALEPAYYQGVYSRPVL

SEQ ID NO: 982 - protein, 80 aa, synthetic construct
GQNRPLIKPKRRLSAARRAGTCCANCQTTTTTLWRRNANGDPVCNACGLYYKLHNVNRPLTMKKEGIQTRNRKMSNKSKK

SEQ ID NO: 983 - protein, 80 aa, synthetic construct
DSLSGSSLYSTSANLPVMGHEKFPSDLDLDMFNGSLECDMESIIRSELMDADGLDFNFDSLISTQNVVGLNVGNFTGAKQ

SEQ ID NO: 984 - protein, 80 aa, synthetic construct
TEISLWTVVAAIQAVEKKMESQAARLQSLEGRTGTAEKKLADCEKMAVEFGNQLEGKWAVLGTLLQEYGLLQRRLENVEN

SEQ ID NO: 985 - protein, 80 aa, synthetic construct
MDSGTRRKNATRETTSTLKAWLQEHRKNPYPTKGEKIMLAIITKMTLTQVSTWFANARRRLKKENKMTWPPRNKCADEKR

SEQ ID NO: 986 - protein, 80 aa, synthetic construct
NIEKQIYLPSTRAKTSIVWHFFHVDPQYTWRAICNLCEKSVSRGKPGSHLGTSTLQRHLQARHSPHWTRANKFGVASGEE

SEQ ID NO: 987 - protein, 80 aa, synthetic construct
AKQNDDSEAGAKRPRTTITAKQLETLKNAYKNSPKPARHVREQLSSETGLDMRVVQVWFQNRRAKEKRLKKDAGRHRWGQ

SEQ ID NO: 988 - protein, 80 aa, synthetic construct
DALSYLDQVKLQFGSQPQVYNDFLDIMKEFKSQSIDTPGVISRVSQLFKGHPDLIMGFNTFLPPGYKIEVQTNDMVNVTT

SEQ ID NO: 989 - protein, 80 aa, synthetic construct
DDHTVCLWDINAGPKEGKIVDAKAIFTGHSAVVEDVAWHLLHESLFGSVADDQKLMIWDTRSNTTSKPSHLVDAHTAEVN

SEQ ID NO: 990 - protein, 80 aa, synthetic construct
GSILLDKDGKRKHTRPTFSGQQIFALEKTFEQTKYLAGPERARLAYSLGMTESQVKVWFQNRRTKWRKKHAAEMATAKKK

SEQ ID NO: 991 - protein, 80 aa, synthetic construct
DPTALVEAIVEEVACPICMTFLREPMSIDCGHSFCHSCLSGLWEIPGESQNWGYTCPLCRAPVQPRNLRPNWQLANVVEK

SEQ ID NO: 992 - protein, 80 aa, synthetic construct
QSLPKKVSLSSDTTRKPLEIRSPSAESKKPKWVPPAASGGSRSSSSPLVVVSVKSPNQSLRLGLSRLARVKPLHPNATST

SEQ ID NO: 993 - protein, 80 aa, synthetic construct
AKSSQRKQRDCVNQCKSKPGLSTSIPLRMSSYTFKRPVTRITPHPGNEVRYHQWEESLEKPQQVCWQRRLQGLQAYSSAG

SEQ ID NO: 994 - protein, 80 aa, synthetic construct
VRMVNGKPKKVRKPRTIYSSFQLAALQRRFQKTQYLALPERAELAASLGLTQTQVKIWFQNKRSKIKKIMKNGEMPPEHS

SEQ ID NO: 995 - protein, 80 aa, synthetic construct
LQCNNHACGWDGGDCSLNFNDPWKNCTQSLQCWKYFSDGHCDSQCNSAGCLFDGFDCQRAEGQCNPLYDQYCKDHFSDGH

SEQ ID NO: 996 - protein, 80 aa, synthetic construct
ETWVEEDELFQVQAAPDEDSTTNITKKQKWTVEESEWVKAGVQKYGEGNWAAISKNYPFVNRTAVMIKDRWRTMKRLGMN

SEQ ID NO: 997 - protein, 80 aa, synthetic construct
AEISLWTVVAAIQAVERKVDAQASQLLNLEGRTGTAEKKLADCEKTAVEFGNHMESKWAVLGTLLQEYGLLQRRLENLEN

SEQ ID NO: 998 - protein, 80 aa, synthetic construct
LEKRTLFRLDLVPINRSVGLKAKPTKPVTEVLRPVVARYGLDLSGLLVRLSGEKEPLDLGAPISSLDGQRVVLEEKDPSR

SEQ ID NO: 999 - protein, 80 aa, synthetic construct
PNCLSSSMQLPHGGGRHQELVRFRDVAVVFSPEEWDHLTPEQRNLYKDVMLDNCKYLASLGNWTYKAHVMSSLKQGKEPW

SEQ ID NO: 1000 - protein, 80 aa, synthetic construct
DDYKEGDLRIMPESSESPPTEREPGGVVDGLIGKHVEYTKEDGSKRIGMVIHQVEAKPSVYFIKFDDDFHIYVYDLVKKS

SEQ ID NO: 1001 - protein, 80 aa, synthetic construct
SEPDLPLKRKQRRSRTTFTAEQLEELEKAFERTHYPDIYTREELAQRTKLTEARVQVWFSNRRARWRKQAGANQLAAFNH

SEQ ID NO: 1002 - protein, 80 aa, synthetic construct
AGGVLDKDGKKKHSRPTFSGQQIFALEKTFEQTKYLAGPERARLAYSLGMTESQVKVWFQNRRTKWRKRHAVEMASAKKK

SEQ ID NO: 1003 - protein, 80 aa, synthetic construct
DVMSFSVTVTTIPASQAMNPSSHGQTIPVQAFSEENSIEGTPSKCYCRLKAMIMCKGCGAFCHDDCIGPSKLCVSCLVVR

SEQ ID NO: 1004 - protein, 80 aa, synthetic construct
GGYSSVSSCNGYGRMGLLHQEKLPSDLDGMFIERLDCDMESIIRNDLMDGDTLDFNFDNVLPNQSFPHSVKTTTHSWVSG

SEQ ID NO: 1005 - protein, 80 aa, synthetic construct
GGSPTGFGCKSRPKARSSTGRECVNCGATSTPLWRRDGTGHYLCNACGLYHKMNGQNRPLIKPKRRLSAARRAGTSCANC

SEQ ID NO: 1006 - protein, 80 aa, synthetic construct
GQNRPLIRPKKRLIVSKRAGTQCTNCQTTTTTLWRRNASGDPVCNACGLYYKLHQVNRPLTMRKDGIQTRNRKASGKGKK

SEQ ID NO: 1007 - protein, 80 aa, synthetic construct
PVALLRKQNFQPTAQQQLTKPAKITCANCKKPLQKGQTAYQRKGSAHLFCSTTCLSSFSHKRTQNTRSIICKKDASTKKA

SEQ ID NO: 1008 - protein, 80 aa, synthetic construct
TEITLWTVVAAIQALEKKVDSCLTRLLTLEGRTGTAEKKLADCEKTAVEFGNQLEGKWAVLGTLLQEYGLLQRRLENVEN

SEQ ID NO: 1009 - protein, 80 aa, synthetic construct
KKQRGRPSSQPRRNIVGCRISHGWKEGDEPITQWKGTVLDQVPINPSLYLVKYDGIDCVYGLELHRDERVLSLKILSDRV

SEQ ID NO: 1010 - protein, 80 aa, synthetic construct
WTCDLDDDCGDRSDESASCAYPTCFPLTQFTCNNGRCININWRCDNDNDCGDNSDEAGCSHSCSSTQFKCNSGRCIPEHW

SEQ ID NO: 1011 - protein, 80 aa, synthetic construct
PKGAAAPSASQRRKRTSFSAEQLQLLELVFRRTRYPDIHLRERLAALTLLPESRIQVWFQNRRAKSRRQSGKSFQPLARP

SEQ ID NO: 1012 - protein, 80 aa, synthetic construct
KIKYDWYQTESQVVITLMIKNVQKNDVNVEFSEKELSALVKLPSGEDYNLKLELLHPIIPEQSTFKVLSTKIEIKLKKPE

SEQ ID NO: 1013 - protein, 80 aa, synthetic construct
DPSKEVEYVCELCKGAAPPDSPVVYSDRAGYNKQWHPTCFVCAKCSEPLVDLIYFWKDGAPWCGRHYCESLRPRCSGCDE

SEQ ID NO: 1014 - protein, 80 aa, synthetic construct
GSGAGKAKKSVDKNSNEYRVRRERNNIAVRKSRDKAKQRNVETQQKVLELTSDNDRLRKRVEQLSRELDTLRGIFRQLPE

SEQ ID NO: 1015 - protein, 80 aa, synthetic construct
GPASSFTPKQRSKARSCSEGRECVNCGATATPLWRRDGTGHYLCNACGLYHKMNGQNRPLIKPKRRLSAARRAGTCCANC

SEQ ID NO: 1016 - protein, 80 aa, synthetic construct
KPSDHIKRPMNAFMVWSRGQRRKMAQENPKMHNSEISKRLGAEWKLLSEAEKRPYIDEAKRLRAQHMKEHPDYKYRPRRK

SEQ ID NO: 1017 - protein, 80 aa, synthetic construct
LYSGFQQTADKCSVCGHLIMEMILQALGKSYHPGCFRCSVCNECLDGVPFTVDVENNIYCVRDYHTVFAPKCASCARPIL

SEQ ID NO: 1018 - protein, 80 aa, synthetic construct
HPSQDLVFSASPDATIRIWSVPNASCVQVVRAHESAVTGLSLHATGDYLLSSSDDQYWAFSDIQTGRVLTKVTDETSGCS

SEQ ID NO: 1019 - protein, 80 aa, synthetic construct
ELSAVGERVFAAESIIKRRIRKGRIEYLVKWKGWAIKYSTWEPEENILDSRLIAAFEQKERERELYGPKKRGPKPKTFLL

SEQ ID NO: 1020 - protein, 80 aa, synthetic construct
RTGSDSKSGKPRRARTAFTYEQLVALENKFKATRYLSVCERLNLALSLSLTETQVKIWFQNRRTKWKKQNPGADTSAPTG

SEQ ID NO: 1021 - protein, 80 aa, synthetic construct
VWDLSKIGEEQSPEDAEDGPPELLFIHGGHTAKISDFSWNPNEPWVICSVSEDNIMQVWQMAENIYNDEDPEGSVDPEGQ

SEQ ID NO: 1022 - protein, 80 aa, synthetic construct
ERCTPAGGGAEPRKLSRTPKCARCRNHGVVSCLKGHKRFCRWRDCQCANCLLVVERQRVMAAQVALRRQQATEDKKGLSG

SEQ ID NO: 1023 - protein, 80 aa, synthetic construct
SQPGALIPGDPQAMSQPNRGPSPFSPVQLHQLRAQILAYKMLARGQPLPETLQLAVQGKRTLPGLQQQQQQQQQQQQQQQ

SEQ ID NO: 1024 - protein, 573 aa, synthetic construct; identical to SEQ ID NO: 551

SEQ ID NO: 1025 - protein, 441 aa, synthetic construct
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 1026 - protein, 485 aa, synthetic construct
MPAMVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 1027 - protein, 1615 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 1028 - protein, 912 aa, Homo sapiens
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 1029 - protein, 301 aa, Homo sapiens
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 1030 - protein, 853 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 1031 - protein, 740 aa, Mus sp.
MRGGSRHLSNEEDVSGCEDCIIISGTCSDQSSDPKTVPLTQVLEAVCTVENRGCRTSSQPSKRKASSLISYVQDLTGDGDEDRDGEVGGSSGSGTPVMPQLFCETRIPSKTPAPLSWQANTSASTPWLSPASPYPIIDLTDEDVIPQSISTPSVDWSQDSHQEGMDTTQVDAESRDGGNIEYQVSADKLLLSQSCILAAFYKLVPYRESIYRTLEKARVRAGKACPSSPGESLEDQLKPMLEWAHGGFKPTGIEGLKPNKKQPENKSRRRTTNDPAASESSPPKRLKTNSYGGKDRGEDEESREQMASDVTNNKGNLEDHCLSCGRKDPVSFHPLFEGGLCQSCRDRFLELFYMYDEDGYQSYCTVCCEGRELLLCSNTSCCRCFCVECLEVLVGAGTAEDVKLQEPWSCYMCLPQRCHGVLRRRKDWNMRLQDFFTTDPDLEEFEPPKLYPAIPAAKRRPIRVLSLFDGIATGYLVLKELGIKVEKYIASEVCAESIAVGTVKHEGQIKYVDDIRNITKEHIDEWGPFDLVIGGSPCNDLSCVNPVRKGLFEGTGRLFFEFYRLLNYSCPEEEDDRPFFWMFENVVAMEVGDKRDISRFLECNPVMIDAIKVSAAHRARYFWGNLPGMNRPVMASKNDKLELQDCLEFSRTAKLKKVQTITTKSNSIRQGKNQLFPVVMNGKDDVLWCTELERIFGFPEHYTDVSNMGRGARQKLLGRSWSVPVIRHLFAPLKDHFACE

SEQ ID NO: 1032 - protein, 387 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 1033 - protein, 213 aa, Homo sapiens
NPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 1034 - protein, 421 aa, Mus sp.
MGSRETPSSCSKTLETLDLETSDSSSPDADSPLEEQWLKSSPALKEDSVDVVLEDCKEPLSPSSPPTGREMIRYEVKVNRRSIEDICLCCGTLQVYTRHPLFEGGLCAPCKDKFLESLFLYDDDGHQSYCTICCSGGTLFICESPDCTRCYCFECVDILVGPGTSERINAMACWVCFLCLPFSRSGLLQRRKRWRHQLKAFHDQEGAGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 1035 - protein, 214 aa, Mus sp.
GPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 1036 - protein, 391 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRIGRQGDMTDSRTNSFLHILDILPRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 1037 - protein, 395 aa, Mycoplasma penetrans
MNSNKDKIKVIKVFEAFAGIGSQFKALKNIARSKNWEIQHSGMVEWFVDAIVSYVAIHSKNFNPKIEQLDKDILSISNDSKMPISEYGIKKINNTIKASYLNYAKKHFNNLFDIKKVNKDNFPKNIDIFTYSFPCQDLSVQGLQKGIDKELNTRSGLLWEIERILEEIKNSFSKEEMPKYLLMENVKNLLSHKNKKNYNTWLKQLEKFGYKSKTYLLNSKNFDNCQNRERVFCLSIRDDYLEKTGFKFKELEKVKNPPKKIKDILVDSSNYKYLNLNKYETTTFRETKSNIISRSLKNYTTFNSENYVYNINGIGPTLTASGANSRIKIETQQGVRYLTPLECFKYMQFDVNDFKKVQSTNLISENKMIYIAGNSIPVKILEAIFNTLEFVNNEE

SEQ ID NO: 1038 - protein, 386 aa, Spiroplasma monobiae
MSKVENKTKKLRVFEAFAGIGAQRKALEKVRKDEYEIVGLAEWYVPAIVMYQAIHNNFHTKLEYKSVSREEMIDYLENKTLSWNSKNPVSNGYWKRKKDDELKIIYNAIKLSEKEGNIFDIRDLYKRTLKNIDLLTYSFPCQDLSQQGIQKGMKRGSGTRSGLLWEIERALDSTEKNDLPKYLLMENVGALLHKKNEEELNQWKQKLESLGYQNSIEVLNAADFGSSQARRRVFMISTLNEFVELPKGDKKPKSIKKVLNKIVSEKDILNNLLKYNLTEFKKTKSNINKASLIGYSKFNSEGYVYDPEFTGPTLTASGANSRIKIKDGSNIRKMNSDETFLYIGFDSQDGKRVNEIEFLTENQKIFVCGNSISVEVLEAIIDKIGG

SEQ ID NO: 1039 - protein, 358 aa, Haemophilus parainfluenzae
MKDVLDDNLLEEPAAQYSLFEPESNPNLREKFTFIDLFAGIGGFRIAMQNLGGKCIFSSEWDEQAQKTYEANFGDLPYGDITLEETKAFIPEKFDILCAGFPCQAFSIAGKRGGFEDTRGTLFFDVAEIIRRHQPKAFFLENVKGLKNHDKGRTLKTILNVLREDLGYFVPEPAIVNAKNFGVPQNRERIYIVGFHKSTGVNSFSYPEPLDKIVTFADIREEKTVPTKYYLSTQYIDTLRKHKERHESKGNGFGYEIIPDDGIANAIVVGGMGRERNLVIDHRITDFTPTTNIKGEVNREGIRKMTPREWARLQGFPDSYVIPVSDASAYKQFGNSVAVPAIQATGKKILEKLGNLYD

SEQ ID NO: 1040 - protein, 521 aa, Arthrobacter luteus
MSKANAKYSFVDLFAGIGGFHAALAATGGVCEYAVEIDREAAAVYERNWNKPALGDITDDANDEGVTLRGYDGPIDVLTGGFPCQPFSKSGAQHGMAETRGTLFWNIARIIEEREPTVLILENVRNLVGPRHRHEWLTIIETLRFFGYEVSGAPAIFSPHLLPAWMGGTPQVRERVFITATLVPERMRDERIPRTETGEIDAEAIGPKPVATMNDRFPIKKGGTELFHPGDRKSGWNLLTSGIIREGDPEPSNVDLRLTETETLWIDAWDDLESTIRRATGRPLEGFPYWADSWTDFRELSRLVVIRGFQAPEREVVGDRKRYVARTDMPEGFVPASVTRPAIDETLPAWKQSHLRRNYDFFERHFAEVVAWAYRWGVYTDLFPASRRKLEWQAQDAPRLWDTVMHFRPSGIRAKRPTYLPALVAITQTSIVGPLERRLSPRETARLQGLPEWFDFGEQRAAATYKQMGNGVNVGVVRHILREHVRRDRALLKLTPAGQRIINAVLADEPDATVGALGAAE

SEQ ID NO: 1041 - protein, 330 aa, Haemophilus aegyptius
MNLISLFSGAGGLDLGFQKAGFRIICANEYDKSIWKTYESNHSAKLIKGDISKISSDEFPKCDGIIGGPPCQSWSEGGSLRGIDDPRGKLFYEYIRILKQKKPIFFLAENVKGMMAQRHNKAVQEFIQEFDNAGYDVHIILLNANDYGVAQDRKRVFYIGFRKELNINYLPPIPHLIKPTFKDVIWDLKDNPIPALDKNKTNGNKCIYPNHEYFIGSYSTIFMSRNRVRQWNEPAFTVQASGRQCQLHPQAPVMLKVSKNLNKFVEGKEHLYRRLTVRECARVQGFPDDFIFHYESLNDGYKMIGNAVPVNLAYEIAKTIKSALEICKGN

SEQ ID NO: 1042 - protein, 327 aa, Haemophilus haemolyticus
MIEIKDKQLTGLRFIDLFAGLGGFRLALESCGAECVYSNEWDKYAQEVYEMNFGEKPEGDITQVNEKTIPDHDILCAGFPCQAFSISGKQKGFEDSRGTLFFDIARIVREKKPKVVFMENVKNFASHDNGNTLEVVKNTMNELDYSFHAKVLNALDYGIPQKRERIYMICFRNDLNIQNFQFPKPFELNTFVKDLLLPDSEVEHLVIDRKDLVMTNQEIEQTTPKTVRLGIVGKGGQGERIYSTRGIAITLSAYGGGIFAKTGGYLVNGKTRKLHPRECARVMGYPDSYKVHPSTSQAYKQFGNSVVINVLQYIAYNIGSSLNFKPY

SEQ ID NO: 1043 - protein, 418 aa, Moraxella sp.
MKPEILKLIRSKLDLTQKQASEIIEVSDKTWQQWESGKTEMHPAYYSFLQEKLKDKINFEELSAQKTLQKKIFDKYNQNQITKNAEELAEITHIEERKDAYSSDFKFIDLFSGIGGIRQSFEVNGGKCVFSSEIDPFAKFTYYTNFGVVPFGDITKVEATTIPQHDILCAGFPCQPFSHIGKREGFEHPTQGTMFHEIVRIIETKKTPVLFLENVPGLINHDDGNTLKVIIETLEDMGYKVHHTVLDASHFGIPQKRKRFYLVAFLNQNIHFEFPKPPMISKDIGEVLESDVTGYSISEHLQKSYLFKKDDGKPSLIDKNTTGAVKTLVSTYHKIQRLTGTFVKDGETGIRLLTTNECKAIMGFPKDFVIPVSRTQMYRQMGNSVVVPVVTKIAEQISLALKTVNQQSPQENFELELV

SEQ ID NO: 1044 - protein, 537 aa, Ascobolus sp.
MSERRYEAGMTVALHEGSFLKIQRVYIRQYHADNRREHMLVGPLFRRTKYLKALSKKVNEVAIVHESIHVPVQDVIGVRELIITNRPFPECRKGDEHTGRLVCRWVYNLDERAKGREYKKQRYIRRITEAEADPEYRVEDRVLRRRWFQEGYIGDEISYKEHGNGDIVDIRSESPLQVLDGWGGDLVDLENGEETSIPGPCRSASSYGRLMKPPLAQAADSNTSRKYTFGDTFCGGGGVSLGARQAGLEVKWAFDMNPNAGANYRRNFPNTDFFLAEAEQFIQLSVGISQHVDILHLSPPCQTFSRAHTIAGKNDENNEASFFAVVNLIKAVRPRLFTVEETDGIMDRQSRQFIDTALMGITELGYSFRICVLNAIEYGVCQNRKRLIIIGAAPGEELPPFPLPTHQDFFSKDPRRDLLPAVTLDDALSTITPESTDHHLNHVWQPAEWKTPYDAHRPFKNAIRAGGGEYDIYPDGRRKFTVRELACIQGFPDEYEFVGTLTDKRRIIGNAVPPPLSAAIMSTLRQWMTEKDFERME

SEQ ID NO: 1045 - protein, 1534 aa, Arabidopsis sp.
MVENGAKAAKRKKRPLPEIQEVEDVPRTRRPRRAAACTSFKEKSIRVCEKSATIEVKKQQIVEEEFLALRLTALETDVEDRPTRRLNDFVLFDSDGVPQPLEMLEIHDIFVSGAILPSDVCTDKEKEKGVRCTSFGRVEHWSISGYEDGSPVIWISTELADYDCRKPAASYRKVYDYFYEKARASVAVYKKLSKSSGGDPDIGLEELLAAVVRSMSSGSKYFSSGAAIIDFVISQGDFIYNQLAGLDETAKKHESSYVEIPVLVALREKSSKIDKPLQRERNPSNGVRIKEVSQVAESEALTSDQLVDGTDDDRRYAILLQDEENRKSMQQPRKNSSSGSASNMFYIKINEDEIANDYPLPSYYKTSEEETDELILYDASYEVQSEHLPHRMLHNWALYNSDLRFISLELLPMKQCDDIDVNIFGSGVVTDDNGSWISLNDPDSGSQSHDPDGMCIFLSQIKEWMIEFGSDDIISISIRTDVAWYRLGKPSKLYAPWWKPVLKTARVGISILTFLRVESRVARLSFADVTKRLSGLQANDKAYISSDPLAVERYLVVHGQIILQLFAVYPDDNVKRCPFVVGLASKLEDRHHTKWIIKKKKISLKELNLNPRAGMAPVASKRKAMQATTTRLVNRIWGEFYSNYSPEDPLQATAAENGEDEVEEEGGNGEEEVEEEGENGLTEDTVPEPVEVQKPHTPKKIRGSSGKREIKWDGESLGKTSAGEPLYQQALVGGEMVAVGGAVTLEVDDPDEMPAIYFVEYMFESTDHCKMLHGRFLQRGSMTVLGNAANERELFLTNECMTTQLKDIKGVASFEIRSRPWGHQYRKKNITADKLDWARALERKVKDLPTEYYCKSLYSPERGGFFSLPLSDIGRSSGFCTSCKIREDEEKRSTIKLNVSKTGFFINGIEYSVEDFVYVNPDSIGGLKEGSKTSFKSGRNIGLRAYVVCQLLEIVPKESRKADLGSFDVKVRRFYRPEDVSAEKAYASDIQELYFSQDTVVLPPGALEGKCEVRKKSDMPLSREYPISDHIFFCDLFFDTSKGSLKQLPANMKPKFSTIKDDTLLRKKKGKGVESEIESEIVKPVEPPKEIRLATLDIFAGCGGLSHGLKKAGVSDAKWAIEYEEPAGQAFKQNHPESTVFVDNCNVILRAIMEKGGDQDDCVSTTEANELAAKLTEEQKSTLPLPGQVDFINGGPPCQGFSGMNRFNQSSWSKVQCEMILAFLSFADYFRPRYFLLENVRTFVSFNKGQTFQLTLASLLEMGYQVRFGILEAGAYGVSQSRKRAFIWAAAPEEVLPEWPEPMHVFGVPKLKISLSQGLHYAAVRSTALGAPFRPITVRDTIGDLPSVENGDSRTNKEYKEVAVSWFQKEIRGNTIALTDHICKAMNELNLIRCKLIPTRPGADWHDLPKRKVTLSDGRVEEMIPFCLPNTAERHNGWKGLYGRLDWQGNFPTSVTDPQPMGKVGMCFHPEQHRILTVRECARSQGFPDSYEFAGNINHKHRQIGNAVPPPLAFALGRKLKEALHLKKSPQHQP

SEQ ID NO: 1046 - protein, 1356 aa, Ascobolus sp.
MELTPELSGVSTDLGGGGSIFAHWRMKEESPAPTEILDDLNVLEWEKTTRDYSKEDLRIADQLFSIEDEHQSLPFETADAEDGTPTEEEEEKELPMRTLDNFVLYDASDLELAALDLIGTELNIHAVGTVGPIYTEGEEDEQEDEDEDVSPPVRTGTQATSASVTQMTVELYIRNIVQYEFCFNDDGTVETWIQTTNAHYKLLQPAKCYTSLYRPVNDCLNVITAIITLAPESTTMSLKDLLKVMDDKAQAVSYEEVERMSEFIVQHLDQWMETAPKKKSKLIEKSKVYIDLNNLAGIDMVSGVRPPPVRRVTGRSSAPKKRIVRNMNDAVLLHQNETTVTNWIHQLSAGMFGRALNVLGAETADVENLTCDPASAKFVVPQRRLHKRLKWETRGHIPVSEEEYKHIYQGKKYAKFFEAVRAVDESKLTIKLGDLVYVLDQDPKVTQTQFATAGREGRKKGAEKEKIQVRFGRVLSIRQPDSNSKDAQNVFIHVQWLVLGCDTILQEMASRRELFLTDSCDTVFADVIYGVAKLTPLGAKDIPTVEFHESMATMMGENEFFVRFKYNYQDGSFTDLKDVDAEQIGTLQPRVNTHRNPGYCSNCRIKYDNERTGDKWIYENDTEGEPRLFRSSKGWCIYAQEFVYLQPVEKQPGTTFRVGYISEINKSSVIVELLARVDDDDKSGHISYSDPRHLYFTGTDIKVTFDKIIRKCFVFHDSGDQKAKAPLMYGTLQRDLYYYRYEKRKGKAELVPVREIRSIHEQTLNDWESRTQIERHGAVSGKKLKGLDIFAGCGGLTLGLDLSGAVDTKWDIEFAPSAANTLALNFPDAQVFNQCANVLLSRAIQSEDEGSLDIEYDLQGRVLPDLPKKGEVDFIYGGPPCQGFSGVNRYKKGNDIKNSLVATFLSYVDHYKPRFVLLENVKGLITTKLGNSKNAEGKWEGGISNGVVKFIYRTLISMNYQCRIGLVQSGEYGVPQSRPRVIFLAARMGERLPDLPEPMHAFEVLDSQYALPHIKRYHTTQNGVAPLPRITIGEAVSDLPKFQYANPGVWPRHDPYSSAKAQPSDKTIEKFSVSKATSFVGYLLQPYHSRPQSEFQRRLRTKLVPSDEPAEKTSLLTTKLVTAHVTRLFNKETTQRIVCVPMWPGADHRSLPKEMRPWCLVDPNSQAEKHRFWPGLFGRLGMEDFFSTALTDVQPCGKQGKVLHPTQRRVYTVRELARAQGFPDWFAFTDGDADSGLGGVKKWHRNIGNAVPVPLGEQIGRCIGYSVWWKDDMIAQLREDGADEDEEMIDGNDQWVEELNTQMAADMPGLPLLVTHLLNLCVYRRLYGPNAKEFLPARVYDKKLEGGRRRLVWAML

SEQ ID NO: 1047 - protein, 1454 aa, Neurospora sp.
MDSPDRSHGGMFIDVPAETMGFQEDYLDMFASVLSQGLAKEGDYAHHQPLPAGKEECLEPIAVATTITPSPDDPQLQLQLELEQQFQTESGLNGVDPAPAPESEDEADLPDGFSDESPDDDFVVQRSKHITVDLPVSTLINPRSTFQRIDENDNLVPPPQSTPERVAVEDLLKAAKAAGKNKEDYIEFELHDFNFYVNYAYHPQEMRPIQLVATKVLHDKYYFDGVLKYGNTKHYVTGMQVLELPVGNYGASLHSVKGQIWVRSKHNAKKEIYYLLKKPAFEYQRYYQPFLWIADLGKHVVDYCTRMVERKREVTLGCFKSDFIQWASKAHGKSKAFQNWRAQHPSDDFRTSVAANIGYIWKEINGVAGAKRAAGDQLFRELMIVKPGQYFRQEVPPGPVVTEGDRTVAATIVTPYIKECFGHMILGKVLRLAGEDAEKEKEVKLAKRLKIENKNATKADTKDDMKNDTATESLPTPLRSLPVQVLEATPIESDIVSIVSSDLPPSENNPPPLTNGSVKPKAKANPKPKPSTQPLHAAHVKYLSQELVNKIKVGDVISTPRDDSSNTDTKWKPTDTDDHRWFGLVQRVHTAKTKSSGRGLNSKSFDVIWFYRPEDTPCCAMKYKWRNELFLSNHCTCQEGHHARVKGNEVLAVHPVDWFGTPESNKGEFFVRQLYESEQRRWITLQKDHLTCYHNQPPKPPTAPYKPGDTVLATLSPSDKFSDPYEVVEYFTQGEKETAFVRLRKLLRRRKVDRQDAPANELVYTEDLVDVRAERIVGKCIMRCFRPDERVPSPYDRGGTGNMFFITHRQDHGRCVPLDTLPPTLRQGFNPLGNLGKPKLRGMDLYCGGGNFGRGLEEGGVVEMRWANDIWDKAIHTYMANTPDPNKTNPFLGSVDDLLRLALEGKFSDNVPRPGEVDFIAAGSPCPGFSLLTQDKKVLNQVKNQSLVASFASFVDFYRPKYGVLENVSGIVQTFVNRKQDVLSQLFCALVGMGYQAQLILGDAWAHGAPQSRERVFLYFAAPGLPLPDPPLPSHSHYRVKNRNIGFLCNGESYVQRSFIPTAFKFVSAGEGTADLPKIGDGKPDACVRFPDHRLASGITPYIRAQYACIPTHPYGMNFIKAWNNGNGVMSKSDRDLFPSEGKTRTSDASVGWKRLNPKTLFPTVTTTSNPSDARMGPGLHWDEDRPYTVQEMRRAQGYLDEEVLVGRTTDQWKLVGNSVSRHMALAIGLKFREAWLGTLYDESAVVATATATATTAAAVGVTVPVMEEPGIGTTESSRPSRSPVHTAVDLDDSKSERSRSTTPATVLSTSSAAGDGSANAAGLEDDDNDDMEMMEVTRKRSSPAVDEEGMRPSKVQKVEVTVASPASRRSSRQASRNPTASPSSKASKATTHEAPAPEELESDAESYSETYDKEGFDGDYHSGHEDQYSEEDEEEEYAEPETMTVNGMTIVKL

SEQ ID NO: 1048 - protein, 345 aa, Drosophila sp.
MVFRVLELFSGIGGMHYAFNYAQLDGQIVAALDVNTVANAVYAHNYGSNLVKTRNIQSLSVKEVTKLQANMLLMSPPCQPHTRQGLQRDTEDKRSDALTHLCGLIPECQELEYILMENVKGFESSQARNQFIESLERSGFHWREFILTPTQFNVPNTRYRYYCIARKGADFPFAGGKIWEEMPGAIAQNQGLSQIAEIVEENVSPDFLVPDDVLTKRVLVMDIIHPAQSRSMCFTKGYTHYTEGTGSAYTPLSEDESHRIFELVKEIDTSNQDASKSEKILQQRLDLLHQVRLRYFTPREVARLMSFPENFEFPPETTNRQKYRLLGNSINVKVVGELIKLLTIK

SEQ ID NO: 1049 - protein, 330 aa, Schizosaccharomyces pombe
MLSTKRLRVLELYSGIGGMHYALNLANIPADIVCAIDINPQANEIYNLNHGKLAKHMDISTLTAKDFDAFDCKLWTMSPSCQPFTRIGNRKDILDPRSQAFLNILNVLPHVNNLPEYILIENVQGFEESKAAEECRKVLRNCGYNLIEGILSPNQFNIPNSRSRWYGLARLNFKGEWSIDDVFQFSEVAQKEGEVKRIRDYLEIERDWSSYMVLESVLNKWGHQFDIVKPDSSSCCCFTRGYTHLVQGAGSILQMSDHENTHEQFERNRMALQLRYFTAREVARLMGFPESLEWSKSNVTEKCMYRLLGNSINVKVVSYLISLLLEPLNF

SEQ ID NO: 1050 - protein, 624 aa, Arabidopsis sp.
MVMSHIFLISQIQEVEHGDSDDVNWNTDDDELAIDNFQFSPSPVHISATSPNSIQNRISDETVASFVEMGFSTQMIARAIEETAGANMEPMMILETLFNYSASTEASSSKSKVINHFIAMGFPEEHVIKAMQEHGDEDVGEITNALLTYAEVDKLRESEDMNININDDDDDNLYSLSSDDEEDELNNSSNEDRILQALIKMGYLREDAAIAIERCGEDASMEEVVDFICAAQMARQFDEIYAEPDKKELMNNNKKRRTYTETPRKPNTDQLISLPKEMIGFGVPNHPGLMMHRPVPIPDIARGPPFFYYENVAMTPKGVWAKISSHLYDIVPEFVDSKHFCAAARKRGYIHNLPIQNRFQIQPPQHNTIQEAFPLTKRWWPSWDGRTKLNCLLTCIASSRLTEKIREALERYDGETPLDVQKWVMYECKKWNLVWVGKNKLAPLDADEMEKLLGFPRDHTRGGGISTTDRYKSLGNSFQVDTVAYHLSVLKPLFPNGINVLSLFTGIGGGEVALHRLQIKMNVVVSVEISDANRNILRSFWEQTNQKGILREFKDVQKLDDNTIERLMDEYGGFDLVIGGSPCNNLAGGNRHHRVGLGGEHSSLFFDYCRILEAVRRKARHMRR

SEQ ID NO: 1051 - protein, 626 aa, Arabidopsis sp.
MVIWNNDDDDFLEIDNFQSSPRSSPIHAMQCRVENLAGVAVTTSSLSSPTETTDLVQMGFSDEVFATLFDMGFPVEMISRAIKETGPNVETSVIIDTISKYSSDCEAGSSKSKAIDHFLAMGFDEEKVVKAIQEHGEDNMEAIANALLSCPEAKKLPAAVEEEDGIDWSSSDDDTNYTDMLNSDDEKDPNSNENGSKIRSLVKMGFSELEASLAVERCGENVDIAELTDFLCAAQMAREFSEFYTEHEEQKPRHNIKKRRFESKGEPRSSVDDEPIRLPNPMIGFGVPNEPGLITHRSLPELARGPPFFYYENVALTPKGVWETISRHLFEIPPEFVDSKYFCVAARKRGYIHNLPINNRFQIQPPPKYTIHDAFPLSKRWWPEWDKRTKLNCILTCTGSAQLTNRIRVALEPYNEEPEPPKHVQRYVIDQCKKWNLVWVGKNKAAPLEPDEMESILGFPKNHTRGGGMSRTERFKSLGNSFQVDTVAYHLSVLKPIFPHGINVLSLFTGIGGGEVALHRLQIKMKLVVSVEISKVNRNILKDFWEQTNQTGELIEFSDIQHLTNDTIEGLMEKYGGFDLVIGGSPCNNLAGGNRVSRVGLEGDQSSLFFEYCRILEVVRARMRGS

SEQ ID NO: 1052 - protein, 791 aa, Arabidopsis sp.
MAARNKQKKRAEPESDLCFAGKPMSVVESTIRWPHRYQSKKTKLQAPTKKPANKGGKKEDEEIIKQAKCHFDKALVDGVLINLNDDVYVTGLPGKLKFIAKVIELFEADDGVPYCRFRWYYRPEDTLIERFSHLVQPKRVFLSNDENDNPLTCIWSKVNIAKVPLPKITSRIEQRVIPPCDYYYDMKYEVPYLNFTSADDGSDASSSLSSDSALNCFENLHKDEKFLLDLYSGCGAMSTGFCMGASISGVKLITKWSVDINKFACDSLKLNHPETEVRNEAAEDFLALLKEWKRLCEKFSLVSSTEPVESISELEDEEVEENDDIDEASTGAELEPGEFEVEKFLGIMFGDPQGTGEKTLQLMVRWKGYNSSYDTWEPYSGLGNCKEKLKEYVIDGFKSHLLPLPGTVYTVCGGPPCQGISGYNRYRNNEAPLEDQKNQQLLVFLDIIDFLKPNYVLMENVVDLLRFSKGFLARHAVASFVAMNYQTRLGMMAAGSYGLPQLRNRVFLWAAQPSEKLPPYPLPTHEVAKKFNTPKEFKDLQVGRIQMEFLKLDNALTLADAISDLPPVTNYVANDVMDYNDAAPKTEFENFISLKRSETLLPAFGGDPTRRLFDHQPLVLGDDDLERVSYIPKQKGANYRDMPGVLVHNNKAEINPRFRAKLKSGKNVVPAYAISFIKGKSKKPFGRLWGDEIVNTVVTRAEPHNQCVIHPMQNRVLSVRENARLQGFPDCYKLCGTIKEKYIQVGNAVAVPVGVALGYAFGMASQGLTDDEPVIKLPFKYPECMQAKDQI

SEQ ID NO: 1053 - protein, 1295 aa, Arabidopsis sp.
MLSPAKCESEEAQAPLDLHSSSRSEPECLSLVLWCPNPEEAAPSSTRELIKLPDNGEMSLRRSTTLNCNSPEENGGEGRVSQRKSSRGKSQPLLMLTNGCQLRRSPRFRALHANFDNVCSVPVTKGGVSQRKFSRGKSQPLLTLTNGCQLRRSPRFRAVDGNFDSVCSVPVTGKFGSRKRKSNSALDKKESSDSEGLTFKDIAVIAKSLEMEIISECQYKNNVAEGRSRLQDPAKRKVDSDTLLYSSINSSKQSLGSNKRMRRSQRFMKGTENEGEENLGKSKGKGMSLASCSFRRSTRLSGTVETGNTETLNRRKDCGPALCGAEQVRGTERLVQISKKDHCCEAMKKCEGDGLVSSKQELLVFPSGCIKKTVNGCRDRTLGKPRSSGLNTDDIHTSSLKISKNDTSNGLTMTTALVEQDAMESLLQGKTSACGAADKGKTREMHVNSTVIYLSDSDEPSSIEYLNGDNLTQVESGSALSSGGNEGIVSLDLNNPTKSTKRKGKRVTRTAVQEQNKRSICFFIGEPLSCEEAQERWRWRYELKERKSKSRGQQSEDDEDKIVANVECHYSQAKVDGHTFSLGDFAYIKGEEEETHVGQIVEFFKTTDGESYFRVQWFYRATDTIMERQATNHDKRRLFYSTVMNDNPVDCLISKVTVLQVSPRVGLKPNSIKSDYYFDMEYCVEYSTFQTLRNPKTSENKLECCADVVPTESTESILKKKSFSGELPVLDLYSGCGGMSTGLSLGAKISGVDVVTKWAVDQNTAACKSLKLNHPNTQVRNDAAGDFLQLLKEWDKLCKRYVFNNDQRTDTLRSVNSTKETSGSSSSSDDDSDSEEYEVEKLVDICFGDHDKTGKNGLKFKVHWKGYRSDEDTWELAEELSNCQDAIREFVTSGFKSKILPLPGRVGVICGGPPCQGISGYNRHRNVDSPLNDERNQQIIVFMDIVEYLKPSYVLMENVVDILRMDKGSLGRYALSRLVNMRYQARLGIMTAGCYGLSQFRSRVFMWGAVPNKNLPPFPLPTHDVIVRYGLPLEFERNVVAYAEGQPRKLEKALVLKDAISDLPHVSNDEDREKLPYESLPKTDFQRYIRSTKRDLTGSAIDNCNKRTMLLHDHRPFHINEDDYARVCQIPKRKGANFRDLPGLIVRNNTVCRDPSMEPVILPSGKPLVPGYVFTFQQGKSKRPFARLWWDETVPTVLTVPTCHSQALLHPEQDRVLTIRESARLQGFPDYFQFCGTIKERYCQIGNAVAVSVSRALGYSLGMAFRGLARDEHLIKLPQNFSHSTYPQLQETIPH

SEQ ID NO: 1054 - protein, 839 aa, Arabidopsis sp.
MAPKRKRPATKDDTTKSIPKPKKRAPKRAKTVKEEPVTVVEEGEKHVARFLDEPIPESEAKSTWPDRYKPIEVQPPKASSRKKTKDDEKVEIIRARCHYRRAIVDERQIYELNDDAYVQSGEGKDPFICKIIEMFEGANGKLYFTARWFYRPSDTVMKEFEILIKKKRVFFSEIQDTNELGLLEKKLNILMIPLNENTKETIPATENCDFFCDMNYFLPYDTFEAIQQETMMAISESSTISSDTDIREGAAAISEIGECSQETEGHKKATLLDLYSGCGAMSTGLCMGAQLSGLNLVTKWAVDMNAHACKSLQHNHPETNVRNMTAEDFLFLLKEWEKLCIHFSLRNSPNSEEYANLHGLNNVEDNEDVSEESENEDDGEVFTVDKIVGISFGVPKKLLKRGLYLKVRWLNYDDSHDTWEPIEGLSNCRGKIEEFVKLGYKSGILPLPGGVDVVCGGPPCQGISGHNRFRNLLDPLEDQKNKQLLVYMNIVEYLKPKFVLMENVVDMLKMAKGYLARFAVGRLLQMNYQVRNGMMAAGAYGLAQFRLRFFLWGALPSEIIPQFPLPTHDLVHRGNIVKEFQGNIVAYDEGHTVKLADKLLLKDVISDLPAVANSEKRDEITYDKDPTTPFQKFIRLRKDEASGSQSKSKSKKHVLYDHHPLNLNINDYERVCQVPKRKGANFRDFPGVIVGPGNVVKLEEGKERVKLESGKTLVPDYALTYVDGKSCKPFGRLWWDEIVPTVVTRAEPHNQVIIHPEQNRVLSIRENARLQGFPDDYKLFGPPKQKYIQVGNAVAVPVAKALGYALGTAFQGLAVGKDPLLTLPEGFAFMKPTLPSELA

SEQ ID NO: 1055 - protein, 142 aa, Neurospora sp.
MAEQNPFVIDDEDDVIQIHDEEEVEEEVAEVIDITEDDIEPSELDRAFGSRPKEETLPSLLLRDQGFIVRPGMTVELKAPIGRFAISFVRVNSIVKVRQAHVNNVTIRGHGFTRAKEMNGMLPKQLNECCLVASIDTRDPRP

SEQ ID NO: 1056 - protein, 529 aa, Escherichia coli
MNNNDLVAKLWKLCDNLRDGGVSYQNYVNELASLLFLKMCKETGQEAEYLPEGYRWDDLKSRIGQEQLQFYRKMLVHLGEDDKKLVQAVFHNVSTTITEPKQITALVSNMDSLDWYNGAHGKSRDDFGDMYEGLLQKNANETKSGAGQYFTPRPLIKTIIHLLKPQPREVVQDPAAGTAGFLIEADRYVKSQTNDLDDLDGDTQDFQIHRAFIGLELVPGTRRLALMNCLLHDIEGNLDHGGAIRLGNTLGSDGENLPKAHIVATNPPFGSAAGTNITRTFVHPTSNKQLCFMQHIIETLHPGGRAAVVVPDNVLFEGGKGTDIRRDLMDKCHLHTILRLPTGIFYAQGVKTNVLFFTKGTVANPNQDKNCTDDVWVYDLRTNMPSFGKRTPFTDEHLQPFERVYGEDPHGLSPRTEGEWSFNAEETEVADSEENKNTDQHLATSRWRKFSREWIRTAKSDSLDISWLKDKDSIDADSLPEPDVLAAEAMGELVQALSELDALMRELGASDEADLQRQLLEEAFGGVKE

SEQ ID NO: 1057 - protein, 464 aa, Escherichia coli
MSAGKLPEGWVIAPVSTVTTLIRGVTYKKEQAINYLKDDYLPLIRANNIQNGKFDTTDLVFVPKNLVKESQKISPEDIVIAMSSGSKSVVGKSAHQHLPFECSFGAFCGVLRPEKLIFSGFIAHFTKSSLYRNKISSLSAGANINNIKPASFDLINIPIPPLAEQKIIAEKLDTLLAQVDSTKARFEQIPQILKRFRQAVLGGAVNGKLTEKWRNFEPQHSVFKKLNFESILTELRNGLSSKPNESGVGHPILRISSVRAGHVDQNDIRFLECSESELNRHKLQDGDLLFTRYNGSLEFVGVCGLLKKLQHQNLLYPDKLIRARLTKDALPEYIEIFFSSPSARNAMMNCVKTTSGQKGISGKDIKSQVVLLPPVKEQAEIVRRVEQLFAYADTIEKQVNNALARVNNLTQSILAKAFRGELTAQWRAENPDLISGENSAAALLEKIKAERAASGGKKASRKKS

SEQ ID NO: 1058 - protein, 421 aa, Thermus aquaticus
MGLPPLLSLPSNSAPRSLGRVETPPEVVDFMVSLAEAPRGGRVLEPACAHGPFLRAFREAHGTAYRFVGVEIDPKALDLPPWAEGILADFLLWEPGEAFDLILGNPPYGIVGEASKYPIHVFKAVKDLYKKAFSTWKGKYNLYGAFLEKAVRLLKPGGVLVFVVPATWLVLEDFALLREFLAREGKTSVYYLGEVFPQKKVSAVVIRFQKSGKGLSLWDTQESESGFTPILWAEYPHWEGEIIRFETEETRKLEISGMPLGDLFHIRFAARSPEFKKHPAVRKEPGPGLVPVLTGRNLKPGWVDYEKNHSGLWMPKERAKELRDFYATPHLVVAHTKGTRVVAAWDERAYPWREEFHLLPKEGVRLDPSSLVQWLNSEAMQKHVRTLYRDFVPHLTLRMLERLPVRREYGFHTSPESARNF

SEQ ID NO: 1059 - protein, 278 aa, Escherichia coli
MKKNRAFLKWAGGKYPLLDDIKRHLPKGECLVEPFVGAGSVFLNTDFSRYILADINSDLISLYNIVKMRTDEYVQAARELFVPETNCAEVYYQFREEFNKSQDPFRRAVLFLYLNRYGYNGLCRYNLRGEFNVPFGRYKKPYFPEAELYHFAEKAQNAFFYCESYADSMARADDASVVYCDPPYAPLSATANFTAYHTNSFTLEQQAHLAEIAEGLVERHIPVLISNHDTMLTREWYQRAKLHVVKVRRSISSNGGTRKKVDELLALYKPGVVSPAKK

SEQ ID NO: 1060 - protein, 358 aa, Caulobacter crescentus
MKFGPETIIHGDCIEQMNALPEKSVDLIFADPPYNLQLGGDLLRPDNSKVDAVDDHWDQFESFAAYDKFTREWLKAARRVLKDDGAIWVIGSYHNIFRVGVAVQDLGFWILNDIVWRKSNPMPNFKGTRFANAHETLIWASKSQNAKRYTFNYDALKMANDEVQMRSDWTIPLCTGEERIKGADGQKAHPTQKPEALLYRVILSTTKPGDVILDPFFGVGTTGAAAKRLGRKFIGIEREAEYLEHAKARIAKVVPIAPEDLDVMGSKRAEPRVPFGTIVEAGLLSPGDTLYCSKGTHVAKVRPDGSITVGDLSGSIHKIGALVQSAPACNGWTYWHFKTDAGLAPIDVLRAQVRAGMN

SEQ ID NO: 1061 - protein, 577 aa, Clostridioides difficile
MDDISQDNFLLSKEYENSLDVDTKKASGIYYTPKIIVDYIVKKTLKNHDIIKNPYPRILDISCGCGNFLLEVYDILYDLFEENIYELKKKYDENYWTVDNIHRHILNYCIYGADIDEKAISILKDSLTNKKVVNDLDESDIKINLFCCDSLKKKWRYKFDYIVGNPPYIGHKKLEKKYKKFLLEKYSEVYKDKADLYFCFYKKIIDILKQGGIGSVITPRYFLESLSGKDLREYIKSNVNVQEIVDFLGANIFKNIGVSSCILTFDKKKTKETYIDVFKIKNEDICINKFETLEELLKSSKFEHFNINQRLLSDEWILVNKDDETFYNKIQEKCKYSLEDIAISFQGIITGCDKAFILSKDDVKLNLVDDKFLKCWIKSKNINKYIVDKSEYRLIYSNDIDNENTNKRILDEIIGLYKTKLENRRECKSGIRKWYELQWGREKLFFERKKIMYPYKSNENRFAIDYDNNFSSADVYSFFIKEEYLDKFSYEYLVGILNSSVYDKYFKITAKKMSKNIYDYYPNKVMKIRIFRDNNYEEIENLSKQIISILLNKSIDKGKVEKLQIKMDNLIMDSLGI

SEQ ID NO: 1062 - protein, 835 aa, synthetic construct
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 1063 - protein, 486 aa, synthetic construct
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 1064 - protein, 16 aa, synthetic construct
SGSETPGTSESATPES

SEQ ID NO: 1065 - protein, 4 aa, synthetic construct
SGGS

SEQ ID NO: 1066 - protein, 24 aa, synthetic construct
SGGSSGSETPGTSESATPESSGGS

SEQ ID NO: 1067 - protein, 32 aa, synthetic construct
SGGSSGGSSGSETPGTSESATPESSGGSSGGS

SEQ ID NO: 1068 - protein, 104 aa, synthetic construct
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 1069 - protein, 16 aa, synthetic construct
SGSETPGTSESATPES

SEQ ID NO: 1070 - protein, 24 aa, synthetic construct
SGGSSGGSSGSETPGTSESATPES

SEQ ID NO: 1071 - protein, 40 aa, synthetic construct
SGGSSGGSSGSETPGTSESATPESSGGSSGGSSGGSSGGS

SEQ ID NO: 1072 - protein, 64 aa, synthetic construct
SGGSSGGSSGSETPGTSESATPESSGGSSGGSSGGSSGGSSGSETPGTSESATPESSGGSSGGS

SEQ ID NO: 1073 - protein, 92 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 1074 - protein, 7 aa, synthetic construct
PKKKRKV

SEQ ID NO: 1075 - protein, 20 aa, synthetic construct
AVKRPAATKKAGQAKKKKLD

SEQ ID NO: 1076 - protein, 25 aa, synthetic construct
MSRRRKANPTKLSENAKKLAKEVEN

SEQ ID NO: 1077 - protein, 9 aa, synthetic construct
PAAKRVKLD

SEQ ID NO: 1078 - protein, 9 aa, synthetic construct
KLKIKRPVK

SEQ ID NO: 1079 - protein, 30 aa, synthetic construct
MDSLLMNRRKFLYQFKNVRWAKGRRETYLC

SEQ ID NO: 1080 - protein, 2087 aa, synthetic construct
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVYMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESTGRTLVTFKDVFVDFTREEWKLLDTAQQIVYRNVMLENYKNLVSLGYQLTKPDVILRLEKGEEP

SEQ ID NO: 1081 - protein, 690 aa, synthetic construct
  VARIANT 651..657: note = any amino acid
  VARIANT 659..660: note = TR, LR or LK
  VARIANT 679..685: note = any amino acid
  VARIANT 687..688: note = TR, LR or LK
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVYSRPGERPFQCRICMRNFSXXXXXXXHXXTHTGEKPFQCRICMRNFSXXXXXXXHXXTH

SEQ ID NO: 1082 - DNA, 3182 bp, Hepatitis B virus
  source 1..3182: mol_type = genomic DNA
aattccacaaccttccaccaaactctgcaagatcccagagtgagaggcctgtatttccctgctggtggctccagttcaggaacagtaaaccctgttctgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcttgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaacaaccagcacgggaccatgccggacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctaaattttatgggttatgtcattggatgttatgggtccttgccacaagaacacatcatacaaaaaatcaaagaatgttttagaaaacttcctattaacaggcctattgattggaaagtatgtcaacgaattgtgggtcttttgggttttgctgccccttttacacaatgtggttatcctgcgttgatgcctttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcatgcgtggaaccttttcggctcctctgccgatccatactgcggaactcctagccgcttgttttgctcgcagcaggtctggagcaaacattatcgggactgataactctgttgtcctatcccgcaaatatacatcgtttccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccaaatattgcccaaggtcttacataagaggactcttggactctcagcaatgtcaacgaccgaccttgaggcatacttcaaagactgtttgtttaaagactgggaggagttgggggaggagattaggttaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcgtctagagacctagtagtcagttatgtcaacactaatatgggcctaaagttcaggcaactcttgtggtttcacatttcttgtctcacttttggaagagaaacagttatagagtatttggtgtctttcggagtgtggattcgcactcctccagcttatagaccaccaaatgcccctatcctatcaacacttccggagactactgttgttagacgacgaggcaggtcccctagaagaagaactccctcgcctcgcagacgaaggtctcaatcgccgcgtcgcagaagatctcaatctcgggaatctcaatgttagtattccttggactcataaggtggggaactttactgggctttattcttctactgtacctgtctttaatcctcattggaaaacaccatcttttcctaatatacatttacaccaagacattatcaaaaaatgtgaacagtttgtaggcccactcacagttaatgagaaaagaagattgcaattgattatgcctgccaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacaccgcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagtcaggaaggcagcctaccccgctgtctccacctttgagaaacactcatcctcaggccatgcagtgg

SEQ ID NO: 1083 - DNA, 3182 bp, Hepatitis B virus
  source 1..3182: mol_type = genomic DNA
aattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 1084 - protein, 58 aa, synthetic construct
  VARIANT 19..25: note = any amino acid
  VARIANT 27..28: note = TR, LR or LK
  VARIANT 47..53: note = any amino acid
  VARIANT 55..56: note = TR, LR or LK
SRPGERPFQCRICMRNFSXXXXXXXHXXTHTGEKPFQCRICMRNFSXXXXXXXHXXTH

SEQ ID NO: 1085 - protein, 6 aa, synthetic construct
TGSQKP

SEQ ID NO: 1086 - protein, 9 aa, synthetic construct
TGGGGSQKP

SEQ ID NO: 1087 - RNA, 93 nt, synthetic construct
  source 1..93: mol_type = other RNA
gtttaagagctatgctggaaacagcatagcaagtttaaataaggctagtccgttatcaacttgaaaaagtggcaccgagtcggtgcttttttt

SEQ ID NO: 1088 - RNA, 80 nt, synthetic construct
  source 1..80: mol_type = other RNA
gttttagagctagaaatagcaagttaaaataaggctagtccgttatcaacttgaaaaagtggcaccgagtcggtgctttt

SEQ ID NO: 1089 - RNA, 92 nt, synthetic construct
  source 1..92: mol_type = other RNA
gtttaagagctaagctggaaacagcatagcaagtttaaataaggctagtccgttatcaacttgaaaaagtggcaccgagtcggtgctttttt

SEQ ID NO: 1090 - RNA, 93 nt, synthetic construct
  source 1..93: mol_type = other RNA
gtttaagagctaagctggaaacagcatagcaagtttaaataaggctagtccgttatcaacttgaaaaagtggcaccgagtcggtgcttttttt

SEQ ID NO: 1091 - protein, 25 aa, unidentified
  source 1..25: note = C2H2 class zinc finger protein motif
  VARIANT 2..5: note = any amino acid
  VARIANT 7..18: note = any amino acid
  VARIANT 20..24: note = any amino acid
  VARIANT 4..5: note = residues may be deleted
  VARIANT 23..24: note = residues may be deleted
CXXXXCXXXXXXXXXXXXHXXXXXH

SEQ ID NO: 1092 - protein, 80 aa, synthetic construct
GGPSSGAPPPSGGSPAGSPTSTEEGTSESATPESGPGTSTEPSEGSAPGSPAGSPTSTEEGTSTEPSEGSAPGTSTEPSE

SEQ ID NO: 1093 - RNA, 112 nt, synthetic construct
  source 1..112: mol_type = other RNA
cctgctggtggctccagttcgtttaagagctaagctggaaacagcatagcaagtttaaataaggctagtccgttatcaacttgaaaaagtggcaccgagtcggtgctttttt

SEQ ID NO: 1094 - RNA, 112 nt, synthetic construct
  source 1..112: mol_type = other RNA
ctgaactggagccaccagcagtttaagagctaagctggaaacagcatagcaagtttaaataaggctagtccgttatcaacttgaaaaagtggcaccgagtcggtgctttttt

SEQ ID NO: 1095 - RNA, 112 nt, synthetic construct
  source 1..112: mol_type = other RNA
cctgaactggagccaccagcgtttaagagctaagctggaaacagcatagcaagtttaaataaggctagtccgttatcaacttgaaaaagtggcaccgagtcggtgctttttt

SEQ ID NO: 1096 - RNA, 112 nt, synthetic construct
  source 1..112: mol_type = other RNA
cctcgagaagattgacgatagtttaagagctaagctggaaacagcatagcaagtttaaataaggctagtccgttatcaacttgaaaaagtggcaccgagtcggtgctttttt

SEQ ID NO: 1097 - RNA, 112 nt, synthetic construct
  source 1..112: mol_type = other RNA
tcgtcaatcttctcgaggatgtttaagagctaagctggaaacagcatagcaagtttaaataaggctagtccgttatcaacttgaaaaagtggcaccgagtcggtgctttttt

SEQ ID NO: 1098 - RNA, 112 nt, synthetic construct
  source 1..112: mol_type = other RNA
cgtcaatcttctcgaggattgtttaagagctaagctggaaacagcatagcaagtttaaataaggctagtccgttatcaacttgaaaaagtggcaccgagtcggtgctttttt

SEQ ID NO: 1099 - RNA, 112 nt, synthetic construct
  source 1..112: mol_type = other RNA
gtcaatcttctcgaggattggtttaagagctaagctggaaacagcatagcaagtttaaataaggctagtccgttatcaacttgaaaaagtggcaccgagtcggtgctttttt

SEQ ID NO: 1100 - RNA, 112 nt, synthetic construct
  source 1..112: mol_type = other RNA
aacatggagaacatcacatcgtttaagagctaagctggaaacagcatagcaagtttaaataaggctagtccgttatcaacttgaaaaagtggcaccgagtcggtgctttttt

SEQ ID NO: 1101 - RNA, 112 nt, synthetic construct
  source 1..112: mol_type = other RNA
aacatcacatcaggattcctgtttaagagctaagctggaaacagcatagcaagtttaaataaggctagtccgttatcaacttgaaaaagtggcaccgagtcggtgctttttt

SEQ ID NO: 1102 - RNA, 112 nt, synthetic construct
  source 1..112: mol_type = other RNA
ctagactctgcggtattgtggtttaagagctaagctggaaacagcatagcaagtttaaataaggctagtccgttatcaacttgaaaaagtggcaccgagtcggtgctttttt

SEQ ID NO: 1103 - RNA, 112 nt, synthetic construct
  source 1..112: mol_type = other RNA
taccgcagagtctagactcggtttaagagctaagctggaaacagcatagcaagtttaaataaggctagtccgttatcaacttgaaaaagtggcaccgagtcggtgctttttt

SEQ ID NO: 1104 - RNA, 112 nt, synthetic construct
  source 1..112: mol_type = other RNA
cgcagagtctagactcgtgggtttaagagctaagctggaaacagcatagcaagtttaaataaggctagtccgttatcaacttgaaaaagtggcaccgagtcggtgctttttt

SEQ ID NO: 1105 - RNA, 112 nt, synthetic construct
  source 1..112: mol_type = other RNA
caccacgagtctagactctggtttaagagctaagctggaaacagcatagcaagtttaaataaggctagtccgttatcaacttgaaaaagtggcaccgagtcggtgctttttt

SEQ ID NO: 1106 - RNA, 112 nt, synthetic construct
  source 1..112: mol_type = other RNA
tggacttctctcaattttctgtttaagagctaagctggaaacagcatagcaagtttaaataaggctagtccgttatcaacttgaaaaagtggcaccgagtcggtgctttttt

SEQ ID NO: 1107 - RNA, 112 nt, synthetic construct
  source 1..112: mol_type = other RNA
ggacttctctcaattttctagtttaagagctaagctggaaacagcatagcaagtttaaataaggctagtccgttatcaacttgaaaaagtggcaccgagtcggtgctttttt

SEQ ID NO: 1108 - RNA, 112 nt, synthetic construct
  source 1..112: mol_type = other RNA
gacttctctcaattttctaggtttaagagctaagctggaaacagcatagcaagtttaaataaggctagtccgttatcaacttgaaaaagtggcaccgagtcggtgctttttt

SEQ ID NO: 1109 - RNA, 112 nt, synthetic construct
  source 1..112: mol_type = other RNA
acttctctcaattttctagggtttaagagctaagctggaaacagcatagcaagtttaaataaggctagtccgttatcaacttgaaaaagtggcaccgagtcggtgctttttt

SEQ ID NO: 1110 - RNA, 112 nt, synthetic construct
  source 1..112: mol_type = other RNA
cgaattttggccaagacacagtttaagagctaagctggaaacagcatagcaagtttaaataaggctagtccgttatcaacttgaaaaagtggcaccgagtcggtgctttttt

SEQ ID NO: 1111 - RNA, 112 nt, synthetic construct
  source 1..112: mol_type = other RNA
aggttggggactgcgaatttgtttaagagctaagctggaaacagcatagcaagtttaaataaggctagtccgttatcaacttgaaaaagtggcaccgagtcggtgctttttt

SEQ ID NO: 1112 - RNA, 112 nt, synthetic construct
  source 1..112: mol_type = other RNA
ggcatagcagcaggatgaaggtttaagagctaagctggaaacagcatagcaagtttaaataaggctagtccgttatcaacttgaaaaagtggcaccgagtcggtgctttttt

SEQ ID NO: 1113 - RNA, 112 nt, synthetic construct
  source 1..112: mol_type = other RNA
agaagatgaggcatagcagcgtttaagagctaagctggaaacagcatagcaagtttaaataaggctagtccgttatcaacttgaaaaagtggcaccgagtcggtgctttttt

SEQ ID NO: 1114 - RNA, 112 nt, synthetic construct
  source 1..112: mol_type = other RNA
gctatgcctcatcttcttgtgtttaagagctaagctggaaacagcatagcaagtttaaataaggctagtccgttatcaacttgaaaaagtggcaccgagtcggtgctttttt

SEQ ID NO: 1115 - RNA, 112 nt, synthetic construct
  source 1..112: mol_type = other RNA
gaagaaccaacaagaagatggtttaagagctaagctggaaacagcatagcaagtttaaataaggctagtccgttatcaacttgaaaaagtggcaccgagtcggtgctttttt

SEQ ID NO: 1116 - RNA, 112 nt, synthetic construct
  source 1..112: mol_type = other RNA
catcttcttgttggttcttcgtttaagagctaagctggaaacagcatagcaagtttaaataaggctagtccgttatcaacttgaaaaagtggcaccgagtcggtgctttttt

SEQ ID NO: 1117 - RNA, 112 nt, synthetic construct
  source 1..112: mol_type = other RNA
cccgtttgtcctctaattccgtttaagagctaagctggaaacagcatagcaagtttaaataaggctagtccgttatcaacttgaaaaagtggcaccgagtcggtgctttttt

SEQ ID NO: 1118 - RNA, 112 nt, synthetic construct
  source 1..112: mol_type = other RNA
cctggaattagaggacaaacgtttaagagctaagctggaaacagcatagcaagtttaaataaggctagtccgttatcaacttgaaaaagtggcaccgagtcggtgctttttt

SEQ ID NO: 1119 - RNA, 112 nt, synthetic construct
  source 1..112: mol_type = other RNA
tcctggaattagaggacaaagtttaagagctaagctggaaacagcatagcaagtttaaataaggctagtccgttatcaacttgaaaaagtggcaccgagtcggtgctttttt

SEQ ID NO: 1120 - RNA, 112 nt, synthetic construct
  source 1..112: mol_type = other RNA
tactagtgccatttgttcaggtttaagagctaagctggaaacagcatagcaagtttaaataaggctagtccgttatcaacttgaaaaagtggcaccgagtcggtgctttttt

SEQ ID NO: 1121 - RNA, 112 nt, synthetic construct
  source 1..112: mol_type = other RNA
ccatttgttcagtggttcgtgtttaagagctaagctggaaacagcatagcaagtttaaataaggctagtccgttatcaacttgaaaaagtggcaccgagtcggtgctttttt

SEQ ID NO: 1122 - RNA, 112 nt, synthetic construct
  source 1..112: mol_type = other RNA
catttgttcagtggttcgtagtttaagagctaagctggaaacagcatagcaagtttaaataaggctagtccgttatcaacttgaaaaagtggcaccgagtcggtgctttttt

SEQ ID NO: 1123 - RNA, 112 nt, synthetic construct
  source 1..112: mol_type = other RNA
cctacgaaccactgaacaaagtttaagagctaagctggaaacagcatagcaagtttaaataaggctagtccgttatcaacttgaaaaagtggcaccgagtcggtgctttttt

SEQ ID NO: 1124 - RNA, 112 nt, synthetic construct
  source 1..112: mol_type = other RNA
tttcagttatatggatgatggtttaagagctaagctggaaacagcatagcaagtttaaataaggctagtccgttatcaacttgaaaaagtggcaccgagtcggtgctttttt

SEQ ID NO: 1125 - RNA, 112 nt, synthetic construct
  source 1..112: mol_type = other RNA
caaaagaaaattggtaacaggtttaagagctaagctggaaacagcatagcaagtttaaataaggctagtccgttatcaacttgaaaaagtggcaccgagtcggtgctttttt

SEQ ID NO: 1126 - RNA, 112 nt, synthetic construct
  source 1..112: mol_type = other RNA
taccaattttcttttgtcttgtttaagagctaagctggaaacagcatagcaagtttaaataaggctagtccgttatcaacttgaaaaagtggcaccgagtcggtgctttttt

SEQ ID NO: 1127 - RNA, 112 nt, synthetic construct
  source 1..112: mol_type = other RNA
accaattttcttttgtctttgtttaagagctaagctggaaacagcatagcaagtttaaataaggctagtccgttatcaacttgaaaaagtggcaccgagtcggtgctttttt

SEQ ID NO: 1128 - RNA, 112 nt, synthetic construct
  source 1..112: mol_type = other RNA
acccaaagacaaaagaaaatgtttaagagctaagctggaaacagcatagcaagtttaaataaggctagtccgttatcaacttgaaaaagtggcaccgagtcggtgctttttt

SEQ ID NO: 1129 - RNA, 112 nt, synthetic construct
  source 1..112: mol_type = other RNA
tgacatactttccaatcaatgtttaagagctaagctggaaacagcatagcaagtttaaataaggctagtccgttatcaacttgaaaaagtggcaccgagtcggtgctttttt

SEQ ID NO: 1130 - RNA, 112 nt, synthetic construct
  source 1..112: mol_type = other RNA
cactttctcgccaacttacagtttaagagctaagctggaaacagcatagcaagtttaaataaggctagtccgttatcaacttgaaaaagtggcaccgagtcggtgctttttt

SEQ ID NO: 1131 - RNA, 112 nt, synthetic construct
  source 1..112: mol_type = other RNA
cacagaaaggccttgtaagtgtttaagagctaagctggaaacagcatagcaagtttaaataaggctagtccgttatcaacttgaaaaagtggcaccgagtcggtgctttttt

SEQ ID NO: 1132 - RNA, 112 nt, synthetic construct
  source 1..112: mol_type = other RNA
tgaacctttaccccgttgccgtttaagagctaagctggaaacagcatagcaagtttaaataaggctagtccgttatcaacttgaaaaagtggcaccgagtcggtgctttttt

SEQ ID NO: 1133 - RNA, 112 nt, synthetic construct
  source 1..112: mol_type = other RNA
gggcaacggggtaaaggttcgtttaagagctaagctggaaacagcatagcaagtttaaataaggctagtccgttatcaacttgaaaaagtggcaccgagtcggtgctttttt

SEQ ID NO: 1134 - RNA, 112 nt, synthetic construct
  source 1..112: mol_type = other RNA
tttaccccgttgcccggcaagtttaagagctaagctggaaacagcatagcaagtttaaataaggctagtccgttatcaacttgaaaaagtggcaccgagtcggtgctttttt

SEQ ID NO: 1135 - RNA, 112 nt, synthetic construct
  source 1..112: mol_type = other RNA
gttgccgggcaacggggtaagtttaagagctaagctggaaacagcatagcaagtttaaataaggctagtccgttatcaacttgaaaaagtggcaccgagtcggtgctttttt

SEQ ID NO: 1136 - RNA, 112 nt, synthetic construct
  source 1..112: mol_type = other RNA
cccgttgcccggcaacggccgtttaagagctaagctggaaacagcatagcaagtttaaataaggctagtccgttatcaacttgaaaaagtggcaccgagtcggtgctttttt

SEQ ID NO: 1137 - RNA, 112 nt, synthetic construct
  source 1..112: mol_type = other RNA
ctggccgttgccgggcaacggtttaagagctaagctggaaacagcatagcaagtttaaataaggctagtccgttatcaacttgaaaaagtggcaccgagtcggtgctttttt

SEQ ID NO: 1138 - RNA, 112 nt, synthetic construct
  source 1..112: mol_type = other RNA
cctggccgttgccgggcaacgtttaagagctaagctggaaacagcatagcaagtttaaataaggctagtccgttatcaacttgaaaaagtggcaccgagtcggtgctttttt

SEQ ID NO: 1139 - RNA, 112 nt, synthetic construct
  source 1..112: mol_type = other RNA
acctggccgttgccgggcaagtttaagagctaagctggaaacagcatagcaagtttaaataaggctagtccgttatcaacttgaaaaagtggcaccgagtcggtgctttttt

SEQ ID NO: 1140 - RNA, 112 nt, synthetic construct
  source 1..112: mol_type = other RNA
gcacagacctggccgttgccgtttaagagctaagctggaaacagcatagcaagtttaaataaggctagtccgttatcaacttgaaaaagtggcaccgagtcggtgctttttt

SEQ ID NO: 1141 - RNA, 112 nt, synthetic construct
  source 1..112: mol_type = other RNA
ggcacagacctggccgttgcgtttaagagctaagctggaaacagcatagcaagtttaaataaggctagtccgttatcaacttgaaaaagtggcaccgagtcggtgctttttt

SEQ ID NO: 1142 - RNA, 112 nt, synthetic construct
  source 1..112: mol_type = other RNA
gcaaacacttggcacagaccgtttaagagctaagctggaaacagcatagcaagtttaaataaggctagtccgttatcaacttgaaaaagtggcaccgagtcggtgctttttt

SEQ ID NO: 1143 - RNA, 112 nt, synthetic construct
  source 1..112: mol_type = other RNA
gggttgcgtcagcaaacactgtttaagagctaagctggaaacagcatagcaagtttaaataaggctagtccgttatcaacttgaaaaagtggcaccgagtcggtgctttttt

SEQ ID NO: 1144 - RNA, 112 nt, synthetic construct
  source 1..112: mol_type = other RNA
tttgctgacgcaacccccacgtttaagagctaagctggaaacagcatagcaagtttaaataaggctagtccgttatcaacttgaaaaagtggcaccgagtcggtgctttttt

SEQ ID NO: 1145 - RNA, 112 nt, synthetic construct
  source 1..112: mol_type = other RNA
ctgacgcaacccccactggcgtttaagagctaagctggaaacagcatagcaagtttaaataaggctagtccgttatcaacttgaaaaagtggcaccgagtcggtgctttttt

SEQ ID NO: 1146 - RNA, 112 nt, synthetic construct
  source 1..112: mol_type = other RNA
tgacgcaacccccactggctgtttaagagctaagctggaaacagcatagcaagtttaaataaggctagtccgttatcaacttgaaaaagtggcaccgagtcggtgctttttt

SEQ ID NO: 1147 - RNA, 112 nt, synthetic construct
  source 1..112: mol_type = other RNA
gacgcaacccccactggctggtttaagagctaagctggaaacagcatagcaagtttaaataaggctagtccgttatcaacttgaaaaagtggcaccgagtcggtgctttttt

SEQ ID NO: 1148 - RNA, 112 nt, synthetic construct
  source 1..112: mol_type = other RNA
aacccccactggctggggctgtttaagagctaagctggaaacagcatagcaagtttaaataaggctagtccgttatcaacttgaaaaagtggcaccgagtcggtgctttttt

SEQ ID NO: 1149 - RNA, 112 nt, synthetic construct
  source 1..112: mol_type = other RNA
tcctctgccgatccatactggtttaagagctaagctggaaacagcatagcaagtttaaataaggctagtccgttatcaacttgaaaaagtggcaccgagtcggtgctttttt

SEQ ID NO: 1150 - RNA, 112 nt, synthetic construct
  source 1..112: mol_type = other RNA
tccgcagtatggatcggcaggtttaagagctaagctggaaacagcatagcaagtttaaataaggctagtccgttatcaacttgaaaaagtggcaccgagtcggtgctttttt

SEQ ID NO: 1151 - RNA, 112 nt, synthetic construct
  source 1..112: mol_type = other RNA
aggagttccgcagtatggatgtttaagagctaagctggaaacagcatagcaagtttaaataaggctagtccgttatcaacttgaaaaagtggcaccgagtcggtgctttttt

SEQ ID NO: 1152 - RNA, 112 nt, synthetic construct
  source 1..112: mol_type = other RNA
cggctaggagttccgcagtagtttaagagctaagctggaaacagcatagcaagtttaaataaggctagtccgttatcaacttgaaaaagtggcaccgagtcggtgctttttt

SEQ ID NO: 1153 - RNA, 112 nt, synthetic construct
  source 1..112: mol_type = other RNA
tgcgagcaaaacaagcggctgtttaagagctaagctggaaacagcatagcaagtttaaataaggctagtccgttatcaacttgaaaaagtggcaccgagtcggtgctttttt

SEQ ID NO: 1154 - RNA, 112 nt, synthetic construct
  source 1..112: mol_type = other RNA
ccgcttgttttgctcgcagcgtttaagagctaagctggaaacagcatagcaagtttaaataaggctagtccgttatcaacttgaaaaagtggcaccgagtcggtgctttttt

SEQ ID NO: 1155 - RNA, 112 nt, synthetic construct
  source 1..112: mol_type = other RNA
cctgctgcgagcaaaacaaggtttaagagctaagctggaaacagcatagcaagtttaaataaggctagtccgttatcaacttgaaaaagtggcaccgagtcggtgctttttt

SEQ ID NO: 1156 - RNA, 112 nt, synthetic construct
  source 1..112: mol_type = other RNA
tgttttgctcgcagcaggtcgtttaagagctaagctggaaacagcatagcaagtttaaataaggctagtccgttatcaacttgaaaaagtggcaccgagtcggtgctttttt

SEQ ID NO: 1157 - RNA, 112 nt, synthetic construct
  source 1..112: mol_type = other RNA
gcagcacagcctagcagccagtttaagagctaagctggaaacagcatagcaagtttaaataaggctagtccgttatcaacttgaaaaagtggcaccgagtcggtgctttttt

SEQ ID NO: 1158 - RNA, 112 nt, synthetic construct
  source 1..112: mol_type = other RNA
tgctaggctgtgctgccaacgtttaagagctaagctggaaacagcatagcaagtttaaataaggctagtccgttatcaacttgaaaaagtggcaccgagtcggtgctttttt

SEQ ID NO: 1159 - RNA, 112 nt, synthetic construct
  source 1..112: mol_type = other RNA
gctgccaactggatcctgcggtttaagagctaagctggaaacagcatagcaagtttaaataaggctagtccgttatcaacttgaaaaagtggcaccgagtcggtgctttttt

SEQ ID NO: 1160 - RNA, 112 nt, synthetic construct
  source 1..112: mol_type = other RNA
ctgccaactggatcctgcgcgtttaagagctaagctggaaacagcatagcaagtttaaataaggctagtccgttatcaacttgaaaaagtggcaccgagtcggtgctttttt

SEQ ID NO: 1161 - RNA, 112 nt, synthetic construct
  source 1..112: mol_type = other RNA
cgtcccgcgcaggatccagtgtttaagagctaagctggaaacagcatagcaagtttaaataaggctagtccgttatcaacttgaaaaagtggcaccgagtcggtgctttttt

SEQ ID NO: 1162 - RNA, 112 nt, synthetic construct
  source 1..112: mol_type = other RNA
aaacaaaggacgtcccgcgcgtttaagagctaagctggaaacagcatagcaagtttaaataaggctagtccgttatcaacttgaaaaagtggcaccgagtcggtgctttttt

SEQ ID NO: 1163 - RNA, 112 nt, synthetic construct
  source 1..112: mol_type = other RNA
gtcctttgtttacgtcccgtgtttaagagctaagctggaaacagcatagcaagtttaaataaggctagtccgttatcaacttgaaaaagtggcaccgagtcggtgctttttt

SEQ ID NO: 1164 - RNA, 112 nt, synthetic construct
  source 1..112: mol_type = other RNA
cgccgacgggacgtaaacaagtttaagagctaagctggaaacagcatagcaagtttaaataaggctagtccgttatcaacttgaaaaagtggcaccgagtcggtgctttttt

SEQ ID NO: 1165 - RNA, 112 nt, synthetic construct
  source 1..112: mol_type = other RNA
tgccgttccgaccgaccacggtttaagagctaagctggaaacagcatagcaagtttaaataaggctagtccgttatcaacttgaaaaagtggcaccgagtcggtgctttttt

SEQ ID NO: 1166 - RNA, 112 nt, synthetic construct
  source 1..112: mol_type = other RNA
aggtgcgccccgtggtcggtgtttaagagctaagctggaaacagcatagcaagtttaaataaggctagtccgttatcaacttgaaaaagtggcaccgagtcggtgctttttt

SEQ ID NO: 1167 - RNA, 112 nt, synthetic construct
  source 1..112: mol_type = other RNA
agagaggtgcgccccgtggtgtttaagagctaagctggaaacagcatagcaagtttaaataaggctagtccgttatcaacttgaaaaagtggcaccgagtcggtgctttttt

SEQ ID NO: 1168 - RNA, 112 nt, synthetic construct
  source 1..112: mol_type = other RNA
gtaaagagaggtgcgccccggtttaagagctaagctggaaacagcatagcaagtttaaataaggctagtccgttatcaacttgaaaaagtggcaccgagtcggtgctttttt

SEQ ID NO: 1169 - RNA, 112 nt, synthetic construct
  source 1..112: mol_type = other RNA
ggggcgcacctctctttacggtttaagagctaagctggaaacagcatagcaagtttaaataaggctagtccgttatcaacttgaaaaagtggcaccgagtcggtgctttttt

SEQ ID NO: 1170 - RNA, 112 nt, synthetic construct
  source 1..112: mol_type = other RNA
cggggagtccgcgtaaagaggtttaagagctaagctggaaacagcatagcaagtttaaataaggctagtccgttatcaacttgaaaaagtggcaccgagtcggtgctttttt

SEQ ID NO: 1171 - RNA, 112 nt, synthetic construct
  source 1..112: mol_type = other RNA
cagatgagaaggcacagacggtttaagagctaagctggaaacagcatagcaagtttaaataaggctagtccgttatcaacttgaaaaagtggcaccgagtcggtgctttttt

SEQ ID NO: 1172 - RNA, 112 nt, synthetic construct
  source 1..112: mol_type = other RNA
gtctgtgccttctcatctgcgtttaagagctaagctggaaacagcatagcaagtttaaataaggctagtccgttatcaacttgaaaaagtggcaccgagtcggtgctttttt

SEQ ID NO: 1173 - RNA, 112 nt, synthetic construct
  source 1..112: mol_type = other RNA
ggcagatgagaaggcacagagtttaagagctaagctggaaacagcatagcaagtttaaataaggctagtccgttatcaacttgaaaaagtggcaccgagtcggtgctttttt

SEQ ID NO: 1174 - RNA, 112 nt, synthetic construct
  source 1..112: mol_type = other RNA
gcagatgagaaggcacagacgtttaagagctaagctggaaacagcatagcaagtttaaataaggctagtccgttatcaacttgaaaaagtggcaccgagtcggtgctttttt

SEQ ID NO: 1175 - RNA, 112 nt, synthetic construct
  source 1..112: mol_type = other RNA
acacggtccggcagatgagagtttaagagctaagctggaaacagcatagcaagtttaaataaggctagtccgttatcaacttgaaaaagtggcaccgagtcggtgctttttt

SEQ ID NO: 1176 - RNA, 112 nt, synthetic construct
  source 1..112: mol_type = other RNA
gaagcgaagtgcacacggtcgtttaagagctaagctggaaacagcatagcaagtttaaataaggctagtccgttatcaacttgaaaaagtggcaccgagtcggtgctttttt

SEQ ID NO: 1177 - RNA, 112 nt, synthetic construct
  source 1..112: mol_type = other RNA
gaggtgaagcgaagtgcacagtttaagagctaagctggaaacagcatagcaagtttaaataaggctagtccgttatcaacttgaaaaagtggcaccgagtcggtgctttttt

SEQ ID NO: 1178 - RNA, 112 nt, synthetic construct
  source 1..112: mol_type = other RNA
cttcacctctgcacgtcgcagtttaagagctaagctggaaacagcatagcaagtttaaataaggctagtccgttatcaacttgaaaaagtggcaccgagtcggtgctttttt

SEQ ID NO: 1179 - RNA, 112 nt, synthetic construct
  source 1..112: mol_type = other RNA
ggtctccatgcgacgtgcaggtttaagagctaagctggaaacagcatagcaagtttaaataaggctagtccgttatcaacttgaaaaagtggcaccgagtcggtgctttttt

SEQ ID NO: 1180 - RNA, 112 nt, synthetic construct
  source 1..112: mol_type = other RNA
tgcccaaggtcttacataaggtttaagagctaagctggaaacagcatagcaagtttaaataaggctagtccgttatcaacttgaaaaagtggcaccgagtcggtgctttttt

SEQ ID NO: 1181 - RNA, 112 nt, synthetic construct
  source 1..112: mol_type = other RNA
gtcctcttatgtaagaccttgtttaagagctaagctggaaacagcatagcaagtttaaataaggctagtccgttatcaacttgaaaaagtggcaccgagtcggtgctttttt

SEQ ID NO: 1182 - RNA, 112 nt, synthetic construct
  source 1..112: mol_type = other RNA
agtcctcttatgtaagacctgtttaagagctaagctggaaacagcatagcaagtttaaataaggctagtccgttatcaacttgaaaaagtggcaccgagtcggtgctttttt

SEQ ID NO: 1183 - RNA, 112 nt, synthetic construct
  source 1..112: mol_type = other RNA
gtcttacataagaggactctgtttaagagctaagctggaaacagcatagcaagtttaaataaggctagtccgttatcaacttgaaaaagtggcaccgagtcggtgctttttt

SEQ ID NO: 1184 - RNA, 112 nt, synthetic construct
  source 1..112: mol_type = other RNA
aatgtcaacgaccgaccttggtttaagagctaagctggaaacagcatagcaagtttaaataaggctagtccgttatcaacttgaaaaagtggcaccgagtcggtgctttttt

SEQ ID NO: 1185 - RNA, 112 nt, synthetic construct
  source 1..112: mol_type = other RNA
tttgaagtatgcctcaaggtgtttaagagctaagctggaaacagcatagcaagtttaaataaggctagtccgttatcaacttgaaaaagtggcaccgagtcggtgctttttt

SEQ ID NO: 1186 - RNA, 112 nt, synthetic construct
  source 1..112: mol_type = other RNA
agtctttgaagtatgcctcagtttaagagctaagctggaaacagcatagcaagtttaaataaggctagtccgttatcaacttgaaaaagtggcaccgagtcggtgctttttt

SEQ ID NO: 1187 - RNA, 112 nt, synthetic construct
  source 1..112: mol_type = other RNA
aagactgtttgtttaaagacgtttaagagctaagctggaaacagcatagcaagtttaaataaggctagtccgttatcaacttgaaaaagtggcaccgagtcggtgctttttt

SEQ ID NO: 1188 - RNA, 112 nt, synthetic construct
  source 1..112: mol_type = other RNA
agactgtttgtttaaagactgtttaagagctaagctggaaacagcatagcaagtttaaataaggctagtccgttatcaacttgaaaaagtggcaccgagtcggtgctttttt

SEQ ID NO: 1189 - RNA, 112 nt, synthetic construct
  source 1..112: mol_type = other RNA
ctgtttgtttaaagactggggtttaagagctaagctggaaacagcatagcaagtttaaataaggctagtccgttatcaacttgaaaaagtggcaccgagtcggtgctttttt

SEQ ID NO: 1190 - RNA, 112 nt, synthetic construct
  source 1..112: mol_type = other RNA
gtttaaagactgggaggagtgtttaagagctaagctggaaacagcatagcaagtttaaataaggctagtccgttatcaacttgaaaaagtggcaccgagtcggtgctttttt

SEQ ID NO: 1191 - RNA, 112 nt, synthetic construct
  source 1..112: mol_type = other RNA
tctttgtactaggaggctgtgtttaagagctaagctggaaacagcatagcaagtttaaataaggctagtccgttatcaacttgaaaaagtggcaccgagtcggtgctttttt

SEQ ID NO: 1192 - RNA, 112 nt, synthetic construct
  source 1..112: mol_type = other RNA
aggaggctgtaggcataaatgtttaagagctaagctggaaacagcatagcaagtttaaataaggctagtccgttatcaacttgaaaaagtggcaccgagtcggtgctttttt

SEQ ID NO: 1193 - RNA, 112 nt, synthetic construct
  source 1..112: mol_type = other RNA
gtgaaaaagttgcatggtgcgtttaagagctaagctggaaacagcatagcaagtttaaataaggctagtccgttatcaacttgaaaaagtggcaccgagtcggtgctttttt

SEQ ID NO: 1194 - RNA, 112 nt, synthetic construct
  source 1..112: mol_type = other RNA
gcagaggtgaaaaagttgcagtttaagagctaagctggaaacagcatagcaagtttaaataaggctagtccgttatcaacttgaaaaagtggcaccgagtcggtgctttttt

SEQ ID NO: 1195 - RNA, 112 nt, synthetic construct
  source 1..112: mol_type = other RNA
aacaagagatgattaggcaggtttaagagctaagctggaaacagcatagcaagtttaaataaggctagtccgttatcaacttgaaaaagtggcaccgagtcggtgctttttt

SEQ ID NO: 1196 - RNA, 112 nt, synthetic construct
  source 1..112: mol_type = other RNA
gacatgaacaagagatgattgtttaagagctaagctggaaacagcatagcaagtttaaataaggctagtccgttatcaacttgaaaaagtggcaccgagtcggtgctttttt

SEQ ID NO: 1197 - RNA, 112 nt, synthetic construct
  source 1..112: mol_type = other RNA
agcttggaggcttgaacagtgtttaagagctaagctggaaacagcatagcaagtttaaataaggctagtccgttatcaacttgaaaaagtggcaccgagtcggtgctttttt

SEQ ID NO: 1198 - RNA, 112 nt, synthetic construct
  source 1..112: mol_type = other RNA
caagcctccaagctgtgcctgtttaagagctaagctggaaacagcatagcaagtttaaataaggctagtccgttatcaacttgaaaaagtggcaccgagtcggtgctttttt

SEQ ID NO: 1199 - RNA, 112 nt, synthetic construct
  source 1..112: mol_type = other RNA
aagcctccaagctgtgccttgtttaagagctaagctggaaacagcatagcaagtttaaataaggctagtccgttatcaacttgaaaaagtggcaccgagtcggtgctttttt

SEQ ID NO: 1200 - RNA, 112 nt, synthetic construct
  source 1..112: mol_type = other RNA
cctccaagctgtgccttggggtttaagagctaagctggaaacagcatagcaagtttaaataaggctagtccgttatcaacttgaaaaagtggcaccgagtcggtgctttttt

SEQ ID NO: 1201 - RNA, 112 nt, synthetic construct
  source 1..112: mol_type = other RNA
ccacccaaggcacagcttgggtttaagagctaagctggaaacagcatagcaagtttaaataaggctagtccgttatcaacttgaaaaagtggcaccgagtcggtgctttttt

SEQ ID NO: 1202 - RNA, 112 nt, synthetic construct
  source 1..112: mol_type = other RNA
agctgtgccttgggtggcttgtttaagagctaagctggaaacagcatagcaagtttaaataaggctagtccgttatcaacttgaaaaagtggcaccgagtcggtgctttttt

SEQ ID NO: 1203 - RNA, 112 nt, synthetic construct
  source 1..112: mol_type = other RNA
aagccacccaaggcacagctgtttaagagctaagctggaaacagcatagcaagtttaaataaggctagtccgttatcaacttgaaaaagtggcaccgagtcggtgctttttt

SEQ ID NO: 1204 - RNA, 112 nt, synthetic construct
  source 1..112: mol_type = other RNA
gctgtgccttgggtggctttgtttaagagctaagctggaaacagcatagcaagtttaaataaggctagtccgttatcaacttgaaaaagtggcaccgagtcggtgctttttt

SEQ ID NO: 1205 - RNA, 112 nt, synthetic construct
  source 1..112: mol_type = other RNA
ctgtgccttgggtggctttggtttaagagctaagctggaaacagcatagcaagtttaaataaggctagtccgttatcaacttgaaaaagtggcaccgagtcggtgctttttt

SEQ ID NO: 1206 - RNA, 112 nt, synthetic construct
  source 1..112: mol_type = other RNA
tagctccaaattctttataagtttaagagctaagctggaaacagcatagcaagtttaaataaggctagtccgttatcaacttgaaaaagtggcaccgagtcggtgctttttt

SEQ ID NO: 1207 - RNA, 112 nt, synthetic construct
  source 1..112: mol_type = other RNA
gtagctccaaattctttatagtttaagagctaagctggaaacagcatagcaagtttaaataaggctagtccgttatcaacttgaaaaagtggcaccgagtcggtgctttttt

SEQ ID NO: 1208 - RNA, 112 nt, synthetic construct
  source 1..112: mol_type = other RNA
taaagaatttggagctactggtttaagagctaagctggaaacagcatagcaagtttaaataaggctagtccgttatcaacttgaaaaagtggcaccgagtcggtgctttttt

SEQ ID NO: 1209 - RNA, 112 nt, synthetic construct
  source 1..112: mol_type = other RNA
atgactctagctacctgggtgtttaagagctaagctggaaacagcatagcaagtttaaataaggctagtccgttatcaacttgaaaaagtggcaccgagtcggtgctttttt

SEQ ID NO: 1210 - RNA, 112 nt, synthetic construct
  source 1..112: mol_type = other RNA
cacatttcttgtctcactttgtttaagagctaagctggaaacagcatagcaagtttaaataaggctagtccgttatcaacttgaaaaagtggcaccgagtcggtgctttttt

SEQ ID NO: 1211 - RNA, 112 nt, synthetic construct
  source 1..112: mol_type = other RNA
tagtttccggaagtgttgatgtttaagagctaagctggaaacagcatagcaagtttaaataaggctagtccgttatcaacttgaaaaagtggcaccgagtcggtgctttttt

SEQ ID NO: 1212 - RNA, 112 nt, synthetic construct
  source 1..112: mol_type = other RNA
cgtctaacaacagtagtttcgtttaagagctaagctggaaacagcatagcaagtttaaataaggctagtccgttatcaacttgaaaaagtggcaccgagtcggtgctttttt

SEQ ID NO: 1213 - RNA, 112 nt, synthetic construct
  source 1..112: mol_type = other RNA
actactgttgttagacgacggtttaagagctaagctggaaacagcatagcaagtttaaataaggctagtccgttatcaacttgaaaaagtggcaccgagtcggtgctttttt

SEQ ID NO: 1214 - RNA, 112 nt, synthetic construct
  source 1..112: mol_type = other RNA
ctgttgttagacgacgaggcgtttaagagctaagctggaaacagcatagcaagtttaaataaggctagtccgttatcaacttgaaaaagtggcaccgagtcggtgctttttt

SEQ ID NO: 1215 - RNA, 112 nt, synthetic construct
  source 1..112: mol_type = other RNA
cgagggagttcttcttctaggtttaagagctaagctggaaacagcatagcaagtttaaataaggctagtccgttatcaacttgaaaaagtggcaccgagtcggtgctttttt

SEQ ID NO: 1216 - RNA, 112 nt, synthetic construct
  source 1..112: mol_type = other RNA
gcgagggagttcttcttctagtttaagagctaagctggaaacagcatagcaagtttaaataaggctagtccgttatcaacttgaaaaagtggcaccgagtcggtgctttttt

SEQ ID NO: 1217 - RNA, 112 nt, synthetic construct
  source 1..112: mol_type = other RNA
ggcgagggagttcttcttctgtttaagagctaagctggaaacagcatagcaagtttaaataaggctagtccgttatcaacttgaaaaagtggcaccgagtcggtgctttttt

SEQ ID NO: 1218 - RNA, 112 nt, synthetic construct
  source 1..112: mol_type = other RNA
ctccctcgcctcgcagacgagtttaagagctaagctggaaacagcatagcaagtttaaataaggctagtccgttatcaacttgaaaaagtggcaccgagtcggtgctttttt

SEQ ID NO: 1219 - RNA, 112 nt, synthetic construct
  source 1..112: mol_type = other RNA
gaccttcgtctgcgaggcgagtttaagagctaagctggaaacagcatagcaagtttaaataaggctagtccgttatcaacttgaaaaagtggcaccgagtcggtgctttttt

SEQ ID NO: 1220 - RNA, 112 nt, synthetic construct
  source 1..112: mol_type = other RNA
agaccttcgtctgcgaggcggtttaagagctaagctggaaacagcatagcaagtttaaataaggctagtccgttatcaacttgaaaaagtggcaccgagtcggtgctttttt

SEQ ID NO: 1221 - RNA, 112 nt, synthetic construct
  source 1..112: mol_type = other RNA
gattgagaccttcgtctgcggtttaagagctaagctggaaacagcatagcaagtttaaataaggctagtccgttatcaacttgaaaaagtggcaccgagtcggtgctttttt

SEQ ID NO: 1222 - RNA, 112 nt, synthetic construct
  source 1..112: mol_type = other RNA
gattgagatcttctgcgacggtttaagagctaagctggaaacagcatagcaagtttaaataaggctagtccgttatcaacttgaaaaagtggcaccgagtcggtgctttttt

SEQ ID NO: 1223 - RNA, 112 nt, synthetic construct
  source 1..112: mol_type = other RNA
gtcgcagaagatctcaatctgtttaagagctaagctggaaacagcatagcaagtttaaataaggctagtccgttatcaacttgaaaaagtggcaccgagtcggtgctttttt

SEQ ID NO: 1224 - RNA, 112 nt, synthetic construct
  source 1..112: mol_type = other RNA
tcgcagaagatctcaatctcgtttaagagctaagctggaaacagcatagcaagtttaaataaggctagtccgttatcaacttgaaaaagtggcaccgagtcggtgctttttt

SEQ ID NO: 1225 - RNA, 112 nt, synthetic construct
  source 1..112: mol_type = other RNA
atatggtgacccacaaaatggtttaagagctaagctggaaacagcatagcaagtttaaataaggctagtccgttatcaacttgaaaaagtggcaccgagtcggtgctttttt

SEQ ID NO: 1226 - RNA, 112 nt, synthetic construct
  source 1..112: mol_type = other RNA
tttgtgggtcaccatattctgtttaagagctaagctggaaacagcatagcaagtttaaataaggctagtccgttatcaacttgaaaaagtggcaccgagtcggtgctttttt

SEQ ID NO: 1227 - RNA, 112 nt, synthetic construct
  source 1..112: mol_type = other RNA
ttgtgggtcaccatattcttgtttaagagctaagctggaaacagcatagcaagtttaaataaggctagtccgttatcaacttgaaaaagtggcaccgagtcggtgctttttt

SEQ ID NO: 1228 - RNA, 112 nt, synthetic construct
  source 1..112: mol_type = other RNA
gctggatccaactggtggtcgtttaagagctaagctggaaacagcatagcaagtttaaataaggctagtccgttatcaacttgaaaaagtggcaccgagtcggtgctttttt

SEQ ID NO: 1229 - RNA, 112 nt, synthetic construct
  source 1..112: mol_type = other RNA
caccccaaaaggcctccgtggtttaagagctaagctggaaacagcatagcaagtttaaataaggctagtccgttatcaacttgaaaaagtggcaccgagtcggtgctttttt

SEQ ID NO: 1230 - RNA, 112 nt, synthetic construct
  source 1..112: mol_type = other RNA
ccttttggggtggagccctcgtttaagagctaagctggaaacagcatagcaagtttaaataaggctagtccgttatcaacttgaaaaagtggcaccgagtcggtgctttttt

SEQ ID NO: 1231 - RNA, 112 nt, synthetic construct
  source 1..112: mol_type = other RNA
cctgagggctccaccccaaagtttaagagctaagctggaaacagcatagcaagtttaaataaggctagtccgttatcaacttgaaaaagtggcaccgagtcggtgctttttt

SEQ ID NO: 1232 - RNA, 112 nt, synthetic construct
  source 1..112: mol_type = other RNA
ggggtggagccctcaggctcgtttaagagctaagctggaaacagcatagcaagtttaaataaggctagtccgttatcaacttgaaaaagtggcaccgagtcggtgctttttt

SEQ ID NO: 1233 - RNA, 112 nt, synthetic construct
  source 1..112: mol_type = other RNA
gggtggagccctcaggctcagtttaagagctaagctggaaacagcatagcaagtttaaataaggctagtccgttatcaacttgaaaaagtggcaccgagtcggtgctttttt

SEQ ID NO: 1234 - RNA, 112 nt, synthetic construct
  source 1..112: mol_type = other RNA
cgattggtggaggcaggagggtttaagagctaagctggaaacagcatagcaagtttaaataaggctagtccgttatcaacttgaaaaagtggcaccgagtcggtgctttttt

SEQ ID NO: 1235 - RNA, 112 nt, synthetic construct
  source 1..112: mol_type = other RNA
ctcatcctcaggccatgcaggtttaagagctaagctggaaacagcatagcaagtttaaataaggctagtccgttatcaacttgaaaaagtggcaccgagtcggtgctttttt

SEQ ID NO: 1236 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcaaagaagttcaatctccttcagcatacccggacccacactggagagaaaccctttcagtgcaggatatgtatgcggaatttttcccggcaagataatttgaattcccatttgagaacacataccgggagtcagaagcctttccaatgccggatttgcatgaggaacttctcccgaagccataatttgaaactccatactagaacacatacaggcgagaagccattccagtgtaggatctgcatgcgcaattttagccaatcaaccactcttaaacgccatctgagaacgcatacaggtagtcagaagccttttcagtgcaggatctgcatgaggaattttagtcgcaacacgaacttgactagacacacaagaacgcatactggagagaagccctttcagtgtaggatttgtatgcggaacttcagcattaaacacaacctggcaaggcatctgaggactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1237 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcaaagaagttcaatctgcttcagcacacccggacccacactggagagaaaccctttcagtgcaggatatgtatgcggaatttttcccgaaaagattacttgattagccacctccgaacacataccgggagtcagaagcctttccaatgccggatttgcatgaggaacttctccaggagccacaaccttaaactgcacacaagaacacatacaggcgagaagccattccagtgtaggatctgcatgcgcaattttagccaatccacaacattgaaaagacatcttcggacgcatacaggtagtcagaagccttttcagtgcaggatctgcatgaggaattttagtcgacaagataatcttggccgacatcttcgaacgcatactggagagaagccctttcagtgtaggatttgtatgcggaacttcagcgtagtaaacaacttgaacagacacttgaaaactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1238 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcaaaaaagtttaaccttctccaacacacacgaacccacactggagagaaaccctttcagtgcaggatatgtatgcggaatttttccagaaaagattatttgatcagtcatctgcgaacacataccgggagtcagaagcctttccaatgccggatttgcatgaggaacttctccaggagtcataacctccggttgcacacacgcacacatacaggcgagaagccattccagtgtaggatctgcatgcgcaattttagccagagtacgaccctgaagagacatctgcggacgcatacaggtagtcagaagccttttcagtgcaggatctgcatgaggaattttagtcggcaagataatttggggagacacttgagaacgcatactggagagaagccctttcagtgtaggatttgtatgcggaacttcagcgttgtgaataatttgaatcggcatctcaaaactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1239 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcacgacgccacattttggacagacatactcggacccacactggagagaaaccctttcagtgcaggatatgtatgcggaatttttcccgccaggacaacttggggcggcatctgcgcacacataccgggagtcagaagcctttccaatgccggatttgcatgaggaacttctcccaatctaccactcttaaacgacacttgcgcacacatacaggcgagaagccattccagtgtaggatctgcatgcgcaattttagccgccgggacggcctggcagggcaccttaagacgcatacaggtagtcagaagccttttcagtgcaggatctgcatgaggaattttagtgttcatcataacctcgttaggcatctgagaacgcatactggagagaagccctttcagtgtaggatttgtatgcggaacttcagcatcagtcacaatttggcgcggcaccttaagactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1240 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcacgccgggaggtattggaaaaccatttgcgaacccacactggagagaaaccctttcagtgcaggatatgtatgcggaatttttcccggcgggataatctcaatcggcacttgaaaacacataccgggagtcagaagcctttccaatgccggatttgcatgaggaacttctcccaatccactaccctcaagcgacatctgcggacacatacaggcgagaagccattccagtgtaggatctgcatgcgcaattttagccgaagggatgggctggcgggccatcttaagacgcatacaggtagtcagaagccttttcagtgcaggatctgcatgaggaattttagtgtccatcacaacctggtcagacaccttaggacgcatactggagagaagccctttcagtgtaggatttgtatgcggaacttcagcatatcacataaccttgcccgacacttgaagactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1241 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcacgcagggcagtgttggatagacatacccggacccacactggagagaaaccctttcagtgcaggatatgtatgcggaatttttcccgacaagataatctggggaggcatctgcggacacataccgggagtcagaagcctttccaatgccggatttgcatgaggaacttctcccaatcaactaccctgaagcgacatctgcgcacacatacaggcgagaagccattccagtgtaggatctgcatgcgcaattttagccgccgcgatgggctggctggacacctgaagacgcatacaggtagtcagaagccttttcagtgcaggatctgcatgaggaattttagtgttcatcacaacttggtccgacaccttcggacgcatactggagagaagccctttcagtgtaggatttgtatgcggaacttcagcatttcacacaacctcgcgcgccacttgaaaactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1242 - DNA, 7162 bp, synthetic construct
  source 1..7162: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcaagagcagataatctgggtcggcacctccgcacccacactggagagaaaccctttcagtgcaggatatgtatgcggaatttttcccgcaacacgcatctcagttatcaccttaaaacacataccgggagtcagaagcctttccaatgccggatttgcatgaggaacttctccaggggcgacggcttgaggcggcatcttcgcacacatacaggcgagaagccattccagtgtaggatctgcatgcgcaattttagccgcagagacaatttgaacagacatctcaaaacgcatacaggtagtcagaagccttttcagtgcaggatctgcatgaggaattttagtcgagcaagaaacttgacgctgcacacccggacgcatactggagagaagccctttcagtgtaggatttgtatgcggaacttcagcgacccttcatctttgaagcgccatcttcgcactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1243 - DNA, 7171 bp, synthetic construct
  source 1..7171: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcaagagtggatcatctccatcgacacctccggacccacactggagagaaaccctttcagtgcaggatatgtatgcggaatttttcccggagggaacatttgtccggacatctcaagacacataccgggggaggcggtagtcagaagcctttccaatgccggatttgcatgaggaacttctcccaaagttccagcctcgtccgccatcttcgcacacatacaggcgagaagccattccagtgtaggatctgcatgcgcaattttagccgcaaggagcgattggcaacccacctcaagacgcatacaggtagtcagaagccttttcagtgcaggatctgcatgaggaattttagtgtcgcacataacctcacaaggcatctgcgcacgcatactggagagaagccctttcagtgtaggatttgtatgcggaacttcagcattagtcataacctggcaaggcatctcaaaactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1244 - DNA, 7171 bp, synthetic construct
  source 1..7171: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcacgcaagcaccaccttgggagacataccagaacccacactggagagaaaccctttcagtgcaggatatgtatgcggaatttttcccgacgggaacacctcacgattcatttgcggacacataccgggggaggcggtagtcagaagcctttccaatgccggatttgcatgaggaacttctcccagagctcatctctcgtgcggcacctgcggacacatacaggcgagaagccattccagtgtaggatctgcatgcgcaattttagccggaaggagcgattggcgacgcacctgaaaacgcatacaggtagtcagaagccttttcagtgcaggatctgcatgaggaattttagtgtagcccacaacctgactaggcatttgaggacgcatactggagagaagccctttcagtgtaggatttgtatgcggaacttcagcatttctcacaatctcgcgcgacatttgaaaactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1245 - DNA, 7171 bp, synthetic construct
  source 1..7171: mol_type = other DNA
cgtcgatcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataaggagacccaagctaccggtgccaccatgtacccatacgatgttccagattacgcttcgccgaagaaaaagcgcaaggtcaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacatggcagcaatccccgccctggaccccgaggccgagcctagcatggacgtgatcctggtgggctctagcgagctgtcctctagcgtgtctccaggaaccggaagggatctgatcgcatacgaggtgaaggccaatcagcggaacatcgaggacatctgtatctgctgtggcagcctgcaggtgcacacacagcacccactgttcgagggaggaatctgcgcaccctgtaaggataagttcctggacgccctgtttctgtacgacgatgacggctaccagtcctattgctctatctgctgttccggcgagaccctgctgatctgcggcaatccagattgtacaaggtgctattgttttgagtgcgtggactctctggtgggaccaggcaccagcggaaaggtgcacgccatgtccaactgggtgtgctacctgtgcctgccatcctctcgcagcggactgctgcagcggagaaggaagtggagatcccagctgaaggccttctatgatagggagtctgagaaccccctggagatgtttgagaccgtgccagtgtggcgccggcagcccgtgagggtgctgagcctgttcgaggatatcaagaaggagctgacatccctgggctttctggagtccggctctgaccccggacagctgaagcacgtggtggatgtgaccgacacagtgcggaaggatgtggaggagtggggccctttcgacctggtgtacggagcaacccctccactgggacacacatgcgacagacccccttcttggtacctgttccagtttcaccgcctgctgcagtatgcaaggccaaagccaggcagccctagaccattcttttggatgttcgtggataatctggtgctgaacaaggaggatctggacgtggccagcaggtttctggagatggagccagtgaccatcccagacgtgcacggcggctccctgcagaatgccgtgcgcgtgtggtctaacatccctgccatcagaagcaggcactgggcactggtgagcgaggaggagctgtccctgctggcccagaataagcagagcagcaagctggccgccaagtggcctacaaagctggtgaagaactgcttcctgccactgcgggagtacttcaagtatttttccaccgagctgacatctagcctgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgagtcccggccaggggaacggcccttccagtgtcggatctgcatgagaaacttttcacgagtcgatcacctccaccgccacctgcgaacccacactggagagaaaccctttcagtgcaggatatgtatgcggaatttttccaggtccgaccacctcagcttgcacttgaagacacataccgggggaggcggtagtcagaagcctttccaatgccggatttgcatgaggaacttctcccaatctagttcattggtacgacatcttaggacacatacaggcgagaagccattccagtgtaggatctgcatgcgcaattttagccgaaaagagcggctggcgacccacttgaaaacgcatacaggtagtcagaagccttttcagtgcaggatctgcatgaggaattttagtgtagcgcataacttgacacggcacttgcgcacgcatactggagagaagccctttcagtgtaggatttgtatgcggaacttcagcatttcccataatctggcgcggcacctgaagactcatttgcgcgggtctagccccaagaagaagagaaaggtgggagtcgacggatccagcggctccgagaccccaggcacatctgagagcgccacccctgagtcccggaccctggtgacattcaaggacgtgttcgtggacttcacccgggaggagtggaagctgctggacacagcccagcagatcgtgtacaggaacgtgatgctggagaactataagaatctggtgtctctgggctaccagctgacaaagccagatgtgatcctgcggctggagaagggagaggagccctggctggtgtagtctagaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgttaattaaaaaaaaaaaaaaaaaaaaaaaaaaaaaaaaaaaaaaaaaaaaaaaaaaaactagtggcgcctgatgcggtattttctccttacgcatctgtgcggtatttcacaccgcataatccagcacagtggcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctga

SEQ ID NO: 1246 - DNA, 10942 bp, synthetic construct; identical to SEQ ID NO: 493
  source 1..10942: mol_type = other DNA

SEQ ID NO: 1247 - DNA, 6981 bp, synthetic construct; identical to SEQ ID NO: 494
  source 1..6981: mol_type = other DNA

SEQ ID NO: 1248 - protein, 2326 aa, synthetic construct; identical to SEQ ID NO: 492

SEQ ID NO: 1249 - RNA, 100 nt, synthetic construct
  source 1..100: mol_type = other RNA
  modified_base 1..3: mod_base = OTHER; note = 2'-O-Methyl modified nucleotide phosphorothioate
  modified_base 30..40: mod_base = OTHER; note = 2'-O-Methyl modified nucleotide
  modified_base 79..100: mod_base = OTHER; note = 2'-O-Methyl modified nucleotide
  modified_base 97..99: mod_base = OTHER; note = Phosphorothioate linkage
aggagttccgcagtatggatgttttagagctagaaatagcaagttaaaataaggctagtccgttatcaacttgaaaaagtggcaccgagtcggtgctttt

SEQ ID NO: 1250 - DNA, 9235 bp, synthetic construct
  source 1..9235: mol_type = other DNA
aggggcgctcgagcaggttcagaaggagatcaaaaacccccaaggatcaaacatgaagagacctgctgccaccaagaaggccggccaggccaagaaaaagtacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacagtccccttgagatgtataaaactgtgcctgtgtggaagagagagccagtgcgggtgctgtccctttttggtgacatcaagaaagagctgacgactttgggctttctggaaaacggctctgacccgggccgactgaaacatttggacgatgtcaccaatacggtgaggagggacgtggaagaatggggcccgttcgacctcgtgtacggctccacgccgcccctcggccacgcctgtgaccatcctcccgggtggtacctgttccagttccaccgtgtgcttcagtacgcgaggcccaggccgggcagcccgcaggccttcttctggatgtttgtggacaacctggtgctgaccgaggatgaccgggctgtagccactcgcttcctggagactgacccggtgaccatccaggacgtctgtggcagagctgtccggaacgccgtgcacgtgtggagcaacatcccggccgtgaaaagcaggcactcggccctgttttcccaggaggaatcattcctgcgggctcaggacaggcagagagcaaagccccccgcccgggggccagccaagctggtgaagaattgttttctccccctgagagaatatttcaagtatttttcaacagaattcacttcctctttgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctaaacgtccggcagcaaccaaaaaagcaggtcaggccaagaaaaaatgaggatcctgagtctagaaaagatatatataggattgaagatctctcagttaagtctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagcctcctgcaggaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaagcccaatctgaataatgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgcatcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactata

SEQ ID NO: 1251 - DNA, 9225 bp, synthetic construct
  source 1..9225: mol_type = other DNA
aggggcgctcgagcaggttcagaaggagatcaaaaacccccaaggatcaaacatgaagagacctgctgccaccaagaaggccggccaggccaagaaaaagtacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacagtccccttgagatgtataaaactgtgcctgtgtggaagagagagccagtgcgggtgctgtccctttttggtgacatcaagaaagagctgacgactttgggctttctggaaaacggctctgacccgggccgactgaaacatttggacgatgtcaccaatacggtgaggagggacgtggaagaatggggcccgttcgacctcgtgtacggctccacgccgcccctcggccacgcctgtgaccatcctcccgggtggtacctgttccagttccaccgtgtgcttcagtacgcgaggcccaggccgggcagcccgcaggccttcttctggatgtttgtggacaacctggtgctgaccgaggatgaccgggctgtagccactcgcttcctggagactgacccggtgaccatccaggacgtctgtggcagagctgtccggaacgccgtgcacgtgtggagcaacatcccggccgtgaaaagcaggcactcggccctgttttcccaggaggaatcattcctgcgggctcaggacaggcagagagcaaagccccccgcccgggggccagccaagctggtgaagaattgttttctccccctgagagaatatttcaagtatttttcaacagaattcacttcctctttgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctaaacgtccggcagcaaccaaaaaagcaggtcaggccaagaaaaaatgaggatcctgagtctagaaaagatatatataggattgaagatctctcagttaagtctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggcttgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttaatacgactcactata

SEQ ID NO: 1252 - protein, 2155 aa, synthetic construct
MKRPAATKKAGQAKKKYNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHSPLEMYKTVPVWKREPVRVLSLFGDIKKELTTLGFLENGSDPGRLKHLDDVTNTVRRDVEEWGPFDLVYGSTPPLGHACDHPPGWYLFQFHRVLQYARPRPGSPQAFFWMFVDNLVLTEDDRAVATRFLETDPVTIQDVCGRAVRNAVHVWSNIPAVKSRHSALFSQEESFLRAQDRQRAKPPARGPAKLVKNCFLPLREYFKYFSTEFTSSLGGPSSGAPPPSGGSPAGSPTSTEEGTSESATPESGPGTSTEPSEGSAPGSPAGSPTSTEEGTSTEPSEGSAPGTSTEPSELEDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSSGSETPGTSESATPESTGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLSAKRPAATKKAGQAKKK

SEQ ID NO: 1253 - DNA, 9342 bp, synthetic construct
  source 1..9342: mol_type = other DNA
agaaactagcgtaaattcaaatataggtcaggcttcaacgtcaacaaatatgatgaagagacctgctgccaccaagaaggccggccaggccaagaaaaagtacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacagccctatggagatatacaagacagtgtctgcatggaagagacagccagtgagggtgctgagcctttttgggaatattgataaagaactaaagagtttgggctttttggaaatcggttctgattctgagggaggaacactgaagtacgtggaagatgtcacgaatgtcgtgaggagagacgtggagaaatggggcccctttgacctggtgtatggctcgacgaatcccctaggcaactcttgtgaccgctgtcctggctggtacatgttccaattccaccggatcctgcagtatgcgcggcctcgccaagacagtcagaagcccttcttctggatatttatggacaatctgctgctgactgaggatgatcaagtgacaactgtccgcttccttcagacagaggctgtgaccctccaggatgtccgtggcagagtcctccagaatgctgtgagggtatggagcaacattccaggactgaagagtaagcactcagtcctgacgccaaaggaagaacagtctctgcaagcccaagtcagaaccagaagcaagctgcccacccaggttaaccccctggtgaagacctgccttctccccctgagagagtacttcaagtgtttttctcagaattcacttcctcttggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctgctaaacgtccggcagcaaccaaaaaagcaggtcaggccaagaaaaaatgaggatcctgagtctagaaagagccttctgagcccagcgacttctgaagggccccttgcaaagtaatagggcttctgcctaagcctctccctccagccaataggcagctttcttaactatcctaacaagccttggaccaaatggaaataaagctttttgatgcagtgttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggcttgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttaatacgactcactata

SEQ ID NO: 1254 - protein, 2156 aa, synthetic construct
MKRPAATKKAGQAKKKYNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHSPMEIYKTVSAWKRQPVRVLSLFGNIDKELKSLGFLEIGSDSEGGTLKYVEDVTNVVRRDVEKWGPFDLVYGSTNPLGNSCDRCPGWYMFQFHRILQYARPRQDSQKPFFWIFMDNLLLTEDDQVTTVRFLQTEAVTLQDVRGRVLQNAVRVWSNIPGLKSKHSVLTPKEEQSLQAQVRTRSKLPTQVNPLVKTCLLPLREYFKCFSQNSLPLGGPSSGAPPPSGGSPAGSPTSTEEGTSESATPESGPGTSTEPSEGSAPGSPAGSPTSTEEGTSTEPSEGSAPGTSTEPSELEDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSPKKKRKVGVDGSSGSETPGTSESATPESTGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLSAAKRPAATKKAGQAKKK

SEQ ID NO: 1255 - DNA, 9225 bp, synthetic construct
  source 1..9225: mol_type = other DNA
agaaactagcgtaaattcaaatataggtcaggcttcaacgtcaacaaatatgatgaagagacctgctgccaccaagaaggccggccaggccaagaaaaagtacaatcacgatcaggagttcgacccccctaaggtgtacccaccagtgcctgcagagaagaggaagccaatccgggtgctgagcctgtttgatggcatcgccaccggcctgctggtgctgaaggatctgggcatccaggtggaccggtacatcgcctccgaggtgtgcgaggattctatcaccgtgggcatggtgcgccaccagggcaagatcatgtatgtgggcgacgtgcggtccgtgacacagaagcacatccaggagtggggcccattcgatctggtgatcggcggcagcccctgtaatgacctgtccatcgtgaaccctgcaaggaagggactgtacgagggaaccggccggctgttctttgagttttatagactgctgcacgacgccaggcctaaggagggcgacgatagaccattcttttggctgttcgagaatgtggtggctatgggcgtgagcgataagagggacatctccaggtttctggagtctaaccccgtgatgatcgatgcaaaggaggtgtccgccgcacacagagccaggtatttctggggcaatctgccaggaatgaacaggccactggcaagcaccgtgaatgacaagctggagctgcaggagtgcctggagcacggaaggatcgccaagttttccaaggtgcgcacaatcaccacacggagcaattccatcaagcagggcaaggatcagcacttccccgtgttcatgaacgagaaggaggacatcctgtggtgtaccgagatggagagagtgttcggctttccagtgcactacacagacgtgtctaacatgagcaggctggcaaggcagcggctgctgggcagatcttggagcgtgcccgtgatcaggcacctgttcgcccctctgaaggagtattttgcctgcgtgagcagcggcaactccaatgccaacagccggggcccctctttcagctccggattggtgcctctgagcctgaggggctcccacagtccccttgagatgtataaaactgtgcctgtgtggaagagagagccagtgcgggtgctgtccctttttggtgacatcaagaaagagctgacgactttgggctttctggaaaacggctctgacccgggccgactgaaacatttggacgatgtcaccaatacggtgaggagggacgtggaagaatggggcccgttcgacctcgtgtacggctccacgccgcccctcggccacgcctgtgaccatcctcccgggtggtacctgttccagttccaccgtgtgcttcagtacgcgaggcccaggccgggcagcccgcaggccttcttctggatgtttgtggacaacctggtgctgaccgaggatgaccgggctgtagccactcgcttcctggagactgacccggtgaccatccaggacgtctgtggcagagctgtccggaacgccgtgcacgtgtggagcaacatcccggccgtgaaaagcaggcactcggccctgttttcccaggaggaatcattcctgcgggctcaggacaggcagagagcaaagccccccgcccgggggccagccaagctggtgaagaattgttttctccccctgagagaatatttcaagtatttttcaacagaattcacttcctctttgggaggaccctcctctggcgccccaccacctagcggcggctcccctgccggctctccaaccagcacagaggagggcaccagcgagtccgccacaccagagtctggacctggcaccagcacagagccatccgagggctctgccccaggctctcctgcaggcagccctacctccaccgaagagggcaccagcacagagccttctgagggcagcgccccaggcacctctacagagccaagcgagctcgaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtgggagtcgacggatccagcggctccgagaccccaggcacatctgagagcgccacccctgagtccaccggtatgaacaattcacaggggagagtgacattcgaagacgtgaccgtgaacttcacccagggagaatggcagcgcttgaacccagaacaaaggaacctctatcgggacgtgatgctggaaaactactcaaatttggtgagcgttgggcagggtgagaccactaagcctgacgtgatcctgagattggaacagggcaaggagccttggctcgaggaagaggaagtcctgggctcagggagggccgagaaaaacggtgatataggaggccagatatggaagcctaaggacgtcaaggagagcctgagcgctaaacgtccggcagcaaccaaaaaagcaggtcaggccaagaaaaaatgaggatcctgagtctagaaaagatatatataggattgaagatctctcagttaagtctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggcttgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttaatacgactcactata

SEQ ID NO: 1256 - protein, 2155 aa, synthetic construct; identical to SEQ ID NO: 1252

SEQ ID NO: 1257 - protein, 4 aa, unidentified
  source 1..4: note = hairy-related basic helix-loop-helix (bHLH) motif
WRPW

SEQ ID NO: 1258 - protein, 51 aa, synthetic construct
  VARIANT 12..18: note = any amino acid
  VARIANT 20..21: note = TR, LR or LK
  VARIANT 40..46: note = any amino acid
  VARIANT 48..49: note = TR, LR or LK
FQCRICMRNFSXXXXXXXHXXTHTGEKPFQCRICMRNFSXXXXXXXHXXTH

SEQ ID NO: 1259 - protein, 56 aa, synthetic construct
  VARIANT 13..19: note = any amino acid
  VARIANT 21..22: note = TR, LR or LK
  VARIANT 41..47: note = any amino acid
  VARIANT 49..50: note = TR, LR or LK
PFQCRICMRNFSXXXXXXXHXXTHTGEKPFQCRICMRNFSXXXXXXXHXXTHLRGS

SEQ ID NO: 1260 - protein, 30 aa, synthetic construct
  VARIANT 2..30: note = residues may be deleted
GGGGGGGGGGGGGGGGGGGGGGGGGGGGGG

SEQ ID NO: 1261 - protein, 4 aa, synthetic construct
VRER

SEQ ID NO: 1262 - protein, 52 aa, synthetic construct
  VARIANT 13..19: note = any amino acid
  VARIANT 21..22: note = TR, LR or LK
  VARIANT 41..47: note = any amino acid
  VARIANT 49..50: note = TR, LR or LK
PFQCRICMRNFSXXXXXXXHXXTHTGEKPFQCRICMRNFSXXXXXXXHXXTH

SEQ ID NO: 1263 - protein, 143 aa, synthetic construct
  VARIANT 13..19: note = any amino acid
  VARIANT 21..22: note = TR, LR or LK
  VARIANT 41..47: note = any amino acid
  VARIANT 49..50: note = TR, LR or LK
PFQCRICMRNFSXXXXXXXHXXTHTGEKPFQCRICMRNFSXXXXXXXHXXTHLRGSPKKKRKVSGSETPGTSESATPESTGRTLVTFKDVFVDFTREEWKLLDTAQQIVYRNVMLENYKNLVSLGYQLTKPDVILRLEKGEEP

The invention claimed is:

1. A method, comprising administering an epigenetic editing system to a subject, wherein the subject comprises detectable levels of HBV DNA, HBsAg, and/or HBeAg in plasma of the subject, wherein the epigenetic editing system comprises
   a) a fusion protein comprising
      i) a dCas9 protein domain,
      ii) a DNMT3A domain and
      iii) a human KRAB domain
   or one or more nucleic acid molecules encoding the fusion protein,
   and b) a guide RNA (gRNA) comprising a nucleic acid base sequence selected from the group consisting of SEQ ID NOs: 1093-1110, 1130-1164, 1166-1173, 1175-1199, 1201-1235, and 1249, wherein the nucleic acid base sequence comprises a region complementary to a strand of a target region wherein the target region comprises a sequence selected from the group consisting of SEQ ID NOs: 333-350, 370-404, 406-413, 415-439, and 441-475.

2. The method of claim 1, wherein the fusion protein further comprises a DNMT3L domain.

3. The method of claim 1, wherein the dCas9 protein domain is from *Streptococcus pyogenes* or *Staphylococcus aureus*.

4. The method of claim 3, wherein the dCas9 protein domain comprises a sequence selected from the group consisting of SEQ ID NOs: 12, 13, 27, 28 and 29.

5. The method of claim 3, wherein the dCas9 protein domain is from *Streptococcus pyogenes*.

6. The method of claim 4, wherein the dCas9 protein domain comprises the sequence of SEQ ID NO: 12.

7. The method of claim 1, wherein the DNMT3A domain comprises a sequence selected from the group consisting of SEQ ID NOs: 1028 and 1029.

8. The method of claim 1, wherein the DNMT3A domain comprises a sequence of SEQ ID NO: 1029.

9. The method of claim 1, wherein the human KRAB domain comprises a sequence selected from the group consisting of SEQ ID NOs: 495, 551, 536, 537, 707, and 717.

10. The method of claim 1, wherein the human KRAB domain is a ZIM3 KRAB domain.

11. The method of claim 10, wherein the ZIM3 KRAB domain comprises the sequence of SEQ ID NO: 495.

12. The method of claim 1, wherein the target region comprises the sequence of SEQ ID NO: 391.

13. The method of claim 1, wherein the target region comprises the sequence of SEQ ID NO: 392.

14. The method of claim 1, wherein the gRNA comprises the nucleic acid base sequence of SEQ ID NO: 1151 or 1249.

15. The method of claim 2, wherein the DNMT3L domain is a human DNMT3L domain.

16. The method of claim 2, wherein the DNMT3L domain comprises a sequence selected from the group consisting of SEQ ID NOs: 1032-1035.

17. The method of claim 16, wherein the DNMT3L domain comprises the sequence of SEQ ID NO: 1033.

18. The method of claim 1, wherein the dCas9 protein domain comprises a sequence of SEQ ID NO: 12, the DNMT3A domain comprises a sequence of SEQ ID NO: 1029, and the human KRAB domain comprises a sequence of SEQ ID NO: 495.

19. The method of claim 1, wherein the dCas9 protein domain comprises a sequence with at least 99% sequence identity to the sequence of SEQ ID NO: 12, the DNMT3A domain comprises a sequence with at least 99% sequence identity to the sequence of SEQ ID NO: 1029, and the human KRAB domain comprises a sequence with at least 99% sequence identity to the sequence of SEQ ID NO: 495.

* * * * *